US011447770B1

(12) United States Patent
Liu et al.

(10) Patent No.: US 11,447,770 B1
(45) Date of Patent: Sep. 20, 2022

(54) METHODS AND COMPOSITIONS FOR PRIME EDITING NUCLEOTIDE SEQUENCES

(71) Applicants: The Broad Institute, Inc., Cambridge, MA (US); President and Fellows of Harvard College, Cambridge, MA (US)

(72) Inventors: David R. Liu, Cambridge, MA (US); Andrew Vito Anzalone, Cambridge, MA (US); Gregory Newby, Cambridge, MA (US); Kelcee Everette, Cambridge, MA (US)

(73) Assignees: The Broad Institute, Inc., Cambridge, MA (US); President and Fellows of Harvard College, Cambridge, MA (US)

(*) Notice: Subject to any disclaimer, the term of this patent is extended or adjusted under 35 U.S.C. 154(b) by 0 days.

(21) Appl. No.: 17/219,672

(22) Filed: Mar. 31, 2021

Related U.S. Application Data

(63) Continuation of application No. PCT/US2020/023712, filed on Mar. 19, 2020.

(60) Provisional application No. 62/991,069, filed on Mar. 17, 2020, provisional application No. 63/100,548, filed on Mar. 17, 2020, provisional application No. 62/944,231, filed on Dec. 5, 2019, provisional application No. 62/974,537, filed on Dec. 5, 2019, provisional application No. 62/931,195, filed on Nov. 5, 2019, provisional application No. 62/973,558, filed on Oct. 10, 2019, provisional application No. 62/913,553, filed on Oct. 10, 2019, provisional application No. 62/922,654, filed on Aug. 21, 2019, provisional application No. 62/889,996, filed on Aug. 21, 2019, provisional application No. 62/858,958, filed on Jun. 7, 2019, provisional application No. 62/820,813, filed on Mar. 19, 2019.

(51) Int. Cl.
*C12N 15/11* (2006.01)
*C12N 9/22* (2006.01)
*C12N 9/12* (2006.01)
*C12N 15/90* (2006.01)

(52) U.S. Cl.
CPC .......... *C12N 15/11* (2013.01); *C12N 9/1276* (2013.01); *C12N 9/22* (2013.01); *C12N 15/907* (2013.01); *C12Y 207/07049* (2013.01); *C07K 2319/00* (2013.01); *C12N 2310/20* (2017.05); *C12N 2310/3519* (2013.01)

(58) Field of Classification Search
CPC ........ C12N 2310/5319; C12N 2310/20; C12N 15/90–15/907; C12N 9/1276; C12N 15/11; C12N 9/22; C12N 2310/3519; C12Y 207/07049; C07K 2319/00; C07K 2319/80

See application file for complete search history.

(56) References Cited

U.S. PATENT DOCUMENTS

| 4,182,449 A | 1/1980 | Kozlow |
| 4,186,183 A | 1/1980 | Steck et al. |
| 4,217,344 A | 8/1980 | Vanlerberghe et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,663,290 A | 5/1987 | Weis et al. |
| 4,737,323 A | 4/1988 | Martin et al. |
| 4,774,085 A | 9/1988 | Fidler |
| 4,797,368 A | 1/1989 | Carter et al. |
| 4,837,028 A | 6/1989 | Allen |
| 4,873,316 A | 10/1989 | Meade et al. |
| 4,880,635 A | 11/1989 | Janoff et al. |
| 4,889,818 A | 12/1989 | Gelfand et al. |
| 4,897,355 A | 1/1990 | Eppstein et al. |
| 4,906,477 A | 3/1990 | Kurono et al. |
| 4,911,928 A | 3/1990 | Wallach |

(Continued)

FOREIGN PATENT DOCUMENTS

| AU | 2012244264 A1 | 11/2012 |
| AU | 2012354062 A1 | 7/2014 |

(Continued)

OTHER PUBLICATIONS

Fonfara et al. Phylogeny of Cas9 determines functional exchangeability of dual-RNA and Cas9 among orthologous type II CRISPR-Cas systems. Nucleic Acids Research, vol. 42, No. 4, pp. 2577-2590, Nov. 22, 2013, including pp. 1/67-67/67 of Supplementary Information. (Year: 2013).*
Satomura et al. Precise genome-wide base editing by the CRISPR Nickase system in yeast. Scientific Reports, vol. 7: 2095, May 18, 2017, printed as pp. 1-10, and including pp. 1/5-5/5 of Supplementary Information. (Year: 2017).*
Vriend et al. Nick-initiated homologous recombination: Protecting the genome, one strand at a time. DNA Repair. Vol. 50, pp. 1-13, 2017, available online Dec. 29, 2016. (Year: 2016).*

(Continued)

*Primary Examiner* — Jennifer Dunston
(74) *Attorney, Agent, or Firm* — Wolf, Greenfield & Sacks, P.C.

(57) ABSTRACT

Compositions and methods are provided herein for conducting prime editing of a target DNA molecule (e.g., a genome) that enables the incorporation of a nucleotide change and/or targeted mutagenesis. The compositions include fusion proteins comprising nucleic acid programmable DNA binding proteins (napDNAbp) and a polymerase (e.g., reverse transcriptase), which is guided to a specific DNA sequence by a modified guide RNA, named a PEgRNA. The PEgRNA has been altered (relative to a standard guide RNA) to comprise an extended portion that provides a DNA synthesis template sequence which encodes a single strand DNA flap which is synthesized by the polymerase of the fusion protein and which becomes incorporated into the target DNA molecule.

30 Claims, 166 Drawing Sheets

Specification includes a Sequence Listing.

(56) References Cited

U.S. PATENT DOCUMENTS

| | | |
|---|---|---|
| 4,917,951 A | 4/1990 | Wallach |
| 4,920,016 A | 4/1990 | Allen et al. |
| 4,921,757 A | 5/1990 | Wheatley et al. |
| 4,946,787 A | 8/1990 | Eppstein et al. |
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,851,548 A | 12/1998 | Dattagupta et al. |
| 5,855,910 A | 1/1999 | Ashley et al. |
| 5,962,313 A | 10/1999 | Podsakoff et al. |
| 5,981,182 A | 11/1999 | Jacobs, Jr. et al. |
| 6,057,153 A | 5/2000 | George et al. |
| 6,063,608 A | 5/2000 | Kotewicz et al. |
| 6,156,509 A | 12/2000 | Schellenberger |
| 6,183,998 B1 | 2/2001 | Ivanov et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,846,578 B2 | 9/2014 | McCray et al. |
| 8,889,418 B2 | 11/2014 | Zhang et al. |
| 8,900,814 B2 | 12/2014 | Yasukawa et al. |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,724 B2 | 12/2016 | Oshiack et al. |
| 9,526,784 B2 | 12/2016 | Liu et al. |
| 9,534,210 B2 | 1/2017 | Park et al. |
| 9,580,698 B1 | 2/2017 | Xu et al. |
| 9,610,322 B2 | 4/2017 | Liu et al. |
| 9,637,739 B2 | 5/2017 | Šikšnys et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |

(56) References Cited

U.S. PATENT DOCUMENTS

| | | |
|---|---|---|
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,474 B2 | 9/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,640,767 B2 | 5/2020 | Maianti et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,078,429 B2 | 8/2021 | Liu et al. |
| 11,124,782 B2 | 9/2021 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0264692 A1 | 11/2007 | Liu et al. |
| 2007/0269817 A1 | 11/2007 | Shapero |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |

(56) References Cited

U.S. PATENT DOCUMENTS

| | | |
|---|---|---|
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237758 A1 | 8/2018 | Liu et al. |
| 2018/0237787 A1 | 8/2018 | Maianti et al. |
| 2018/0245066 A1 | 8/2018 | Yao et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |

(56) References Cited

U.S. PATENT DOCUMENTS

| | | |
|---|---|---|
| 2018/0327756 A1 | 11/2018 | Zhang et al. |
| 2019/0010481 A1 | 1/2019 | Joung et al. |
| 2019/0055543 A1 | 2/2019 | Tran et al. |
| 2019/0093099 A1 | 3/2019 | Liu et al. |
| 2019/0185883 A1 | 6/2019 | Liu et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |

FOREIGN PATENT DOCUMENTS

| | | |
|---|---|---|
| AU | 2015252023 A1 | 11/2015 |
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |
| CN | 1069962 A | 3/1993 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |

(56) References Cited

FOREIGN PATENT DOCUMENTS

| | | | |
|---|---|---|---|
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |

(56) References Cited

FOREIGN PATENT DOCUMENTS

| | | |
|---|---|---|
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 U | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |

(56) References Cited

FOREIGN PATENT DOCUMENTS

| | | |
|---|---|---|
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 109 517 841 A | 3/2019 |
| EP | 0264166 A1 | 4/1988 |
| EP | 2604255 A1 | 6/2013 |
| EP | 2840140 A1 | 2/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3 115 457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2528177 A | 1/2016 |
| GB | 2 531 454 A1 | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| KR | 101584933 B1 | 1/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 20170128137 A * | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| TW | I608100 B | 12/2017 |
| TW | 2018-29773 A | 8/2018 |
| WO | WO 90/02809 | 3/1990 |
| WO | WO 1990/002809 | 3/1990 |
| WO | WO 91/16024 A1 | 10/1991 |
| WO | WO 1991/016024 A1 | 10/1991 |
| WO | WO 91/17271 A1 | 11/1991 |
| WO | WO 91/17424 A1 | 11/1991 |
| WO | WO 1991/017271 A1 | 11/1991 |
| WO | WO 1991/017424 A1 | 11/1991 |
| WO | WO 92/06188 A2 | 4/1992 |
| WO | WO 92/06200 A1 | 4/1992 |
| WO | WO 1992/006188 A2 | 4/1992 |
| WO | WO 1992/006200 A1 | 4/1992 |
| WO | WO 93/24641 A2 | 12/1993 |
| WO | WO 1993/024641 A2 | 12/1993 |
| WO | WO 94/18316 A2 | 8/1994 |
| WO | WO 1994/018316 A2 | 8/1994 |
| WO | WO 94/026877 A1 | 11/1994 |
| WO | WO 1994/026877 A1 | 11/1994 |
| WO | WO 96/04403 A1 | 2/1996 |
| WO | WO 1996/004403 A1 | 2/1996 |
| WO | WO 96/10640 A1 | 4/1996 |
| WO | WO 1996/010640 A1 | 4/1996 |
| WO | WO 98/32845 A1 | 7/1998 |
| WO | WO 1998/032845 A1 | 7/1998 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 05/14791 A2 | 2/2005 |
| WO | WO 2005/14791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/066923 A1 | 6/2007 |
| WO | WO 2007/136815 A2 | 11/2007 |
| WO | WO 2007/143574 A1 | 12/2007 |
| WO | WO 2008/005529 A2 | 1/2008 |
| WO | WO 2008/108989 A2 | 9/2008 |
| WO | WO 2009/098290 A1 | 8/2009 |
| WO | WO 2009/134808 A2 | 11/2009 |
| WO | WO 2010/011961 A2 | 1/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/068810 A1 | 6/2011 |
| WO | WO 2011/075627 A1 | 6/2011 |

(56) References Cited

FOREIGN PATENT DOCUMENTS

| | | |
|---|---|---|
| WO | WO 2011/091311 A2 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A1 | 12/2012 |
| WO | WO 2013/012674 A1 | 1/2013 |
| WO | WO 2013/013105 A1 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A2 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |

(56) References Cited

FOREIGN PATENT DOCUMENTS

| | | |
|---|---|---|
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A2 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |

(56) References Cited

FOREIGN PATENT DOCUMENTS

| | | |
|---|---|---|
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A1 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |

(56) References Cited

FOREIGN PATENT DOCUMENTS

| | | |
|---|---|---|
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A2 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |

(56) References Cited

FOREIGN PATENT DOCUMENTS

| | | |
|---|---|---|
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |

(56) References Cited

FOREIGN PATENT DOCUMENTS

| | | |
|---|---|---|
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |

(56) References Cited

FOREIGN PATENT DOCUMENTS

| | | |
|---|---|---|
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A1 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A1 | 8/2018 |
| WO | WO 2018/156372 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/051097 A1 | 3/2019 |
| WO | WO 2019/079347 A1 | 4/2019 |
| WO | WO 2019/084062 A1 | 5/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/226953 A1 | 11/2019 |
| WO | WO 2019/236566 A1 | 12/2019 |
| WO | WO 2020/014261 A1 | 1/2020 |
| WO | WO 2020/028555 A2 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/157008 A1 | 8/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |
| WO | WO 2020/236982 A1 | 11/2020 |
| WO | WO 2021/022043 A2 | 2/2021 |
| WO | WO 2021/025750 A1 | 2/2021 |
| WO | WO 2021/030666 A1 | 2/2021 |
| WO | WO 2021/042062 A2 | 3/2021 |
| WO | WO 2021/072328 A1 | 4/2021 |
| WO | WO 2021/081264 A1 | 4/2021 |
| WO | WO 2021/087182 A1 | 5/2021 |
| WO | WO 2021/108717 A2 | 6/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/178709 A1 | 9/2021 |
| WO | WO 2021/178717 A2 | 9/2021 |
| WO | WO 2021/178720 A2 | 9/2021 |
| WO | WO 2021/178898 A1 | 9/2021 |
| WO | WO 2021/222318 A1 | 11/2021 |
| WO | WO 2021/226558 A1 | 11/2021 |

OTHER PUBLICATIONS

Machine translation of KR20170128137A, printed as pp. 1/22-2/22 on Sep. 9, 2021. (Year: 2021).*
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 17/160,329, filed Jan. 27, 2021, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.

(56) References Cited

OTHER PUBLICATIONS

U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 17/103,233, filed Nov. 24, 2020, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/960,171, filed Apr. 23, 2018, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 16/492,548, filed Sep. 9, 2019, Maianti et al.
U.S. Appl. No. 15/784,033, filed Oct. 13, 2017, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/976,047, filed Aug. 26, 2020, Liu et al.
U.S. Appl. No. 17/289,665, filed Apr. 28, 2021, Liu et al.
U.S. Appl. No. 16/756,432, filed Apr. 15, 2020, Liu et al.
U.S. Appl. No. 16/772,747, filed Jun. 12, 2020, Shen et al.
U.S. Appl. No. 17/057,398, filed Nov. 20, 2020, Liu et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/288,504, filed Apr. 23, 2021, Liu et al.
U.S. Appl. No. 17/219,590, filed Mar. 31, 2021, Liu et al.
U.S. Appl. No. 17/219,635, filed Mar. 31, 2021, Liu et al.
PCT/US2020/023721, Jun. 23, 2020, International Search Report and Written Opinion.
PCT/US2020/023553, Sep. 14, 2020, Invitation to Pay Additional Fees.
PCT/US2020/023553, Nov. 6, 2020, International Search Report and Written Opinion.
PCT/US2020/023583, Jul. 30, 2020, International Search Report and Written Opinion.
PCT/US2020/023730, Jul. 24, 2020, International Search Report and Written Opinion.
PCT/US2020/273713, Jun. 7, 2020, International Search Report and Written Opinion.
PCT/US2020/273712, Jul. 7, 2020, International Search Report and Written Opinion.
PCT/US2020/023727, Jun. 30, 2020, Invitation to Pay Additional Fees.
PCT/US2020/023727, Aug. 12, 2020, International Search Report and Written Opinion.
PCT/US2020/023724, Jun. 29, 2020, International Search Report and Written Opinion.
PCT/US2020/023725, Jun. 29, 2020, International Search Report and Written Opinion.
PCT/US2020/023728, Jul. 9, 2020, International Search Report and Written Opinion.
PCT/US2020/023732, Jul. 3, 2020, International Search Report and Written Opinion.
PCT/US2020/023723, Jun. 26, 2020, International Search Report and Written Opinion.
Abudayyeh et al., A cytosine deaminase for programmable single-base RNA editing. Science. Jul. 26, 2019;365(6451):382-386. doi: 10.1126/science.aax7063. Epub Jul. 11, 2019.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014:546:1-20.
Anderson, Human gene therapy. Science. May 8, 1992;256(5058):808-13. doi: 10.1126/science.1589762.
Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.
Araki et al., Site-specific recombinase, R, encoded by yeast plasmid pSR1. J Mol Biol. May 5, 1992;225(1):25-37. doi: 10.1016/0022-2836(92)91023-i.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Baldari et al., A novel leader peptide which allows efficient secretion of a fragment of human interleukin 1 beta in *Saccharomyces cerevisiae*. EMBO J. Jan. 1987;6(1):229-34.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Barnes et al., The fidelity of Taq polymerase catalyzing PCR is improved by an N-terminal deletion. Gene. Mar. 1, 1992;112(1):29-35. doi: 10.1016/0378-1119(92)90299-5.
Behr, Gene transfer with synthetic cationic amphiphiles: prospects for gene therapy. Bioconjug Chem. Sep.-Oct. 1994;5(5):382-9. doi: 10.1021/bc00029a002.

(56) References Cited

OTHER PUBLICATIONS

Bennett et al., Painful and painless channelopathies. Lancet Neurol. Jun. 2014;13(6):587-99. doi: 10.1016/S1474-4422(14)70024-9. Epub May 6, 2014.

Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.

Bernstein et al., Role for a bidentate ribonuclease in the initiation step of RNA interference. Nature. Jan. 18, 2001;409(6818):363-6. doi: 10.1038/35053110.

Bessen et al., High-resolution specificity profiling and off-target prediction for site-specific DNA recombinases. Nat Commun. Apr. 26, 2019;10(1):1937. doi: 10.1038/s41467-019-09987-0.

Blaese et al., Vectors in cancer therapy: how will they deliver? Cancer Gene Ther. Dec. 1995;2(4):291-7.

Blaisonneau et al., A circular plasmid from the yeast *Torulaspora delbrueckii*. Plasmid. 1997;38(3):202-9. doi: 10.1006/plas.1997.1315.

Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.

Brown et al., A mammalian protein targeted by G1-arresting rapamycin-receptor complex. Nature. Jun. 30, 1994;369(6483):756-8. doi: 10.1038/369756a0.

Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.

Buskirk et al., In vivo evolution of an RNA-based transcriptional activator. Chem Biol. Jun. 2003;10(6):533-40. doi: 10.1016/s1074-5521(03)00109-1.

Calame et al., Transcriptional controlling elements in the immunoglobulin and T cell receptor loci. Adv Immunol. 1988;43:235-75. doi: 10.1016/s0065-2776(08)60367-3.

Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.

Carr et al., Genome engineering. Nat Biotechnol. Dec. 2009;27(12):1151-62. doi: 10.1038/nbt.1590.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chan et al., Novel selection methods for DNA-encoded chemical libraries. Curr Opin Chem Biol. 2015;26:55-61. doi:10.1016/j.cbpa.2015.02.010.

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.

Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.

Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.

Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.

Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.

Cole et al., Reconstructing evolutionary adaptive paths for protein engineering. Methods Mol Biol. 2013;978:115-25. doi: 10.1007/978-1-62703-293-3_8.

Collinge, Prion diseases of humans and animals: their causes and molecular basis. Annu Rev Neurosci. 2001;24:519-50. doi: 10.1146/annurev.neuro.24.1.519.

Cotton et al., Insertion of a Synthetic Peptide into a Recombinant Protein Framework:? A Protein Biosensor. J. Am. Chem. Soc. Jan. 22, 1999; 121(5):1100-1. https://doi.org/10.1021/ja983804b.

Cox, Proteins pinpoint double strand breaks. Elife. Oct. 29, 2013;2:e01561. doi: 10.7554/eLife.01561.

Crabtree et al., Three-part inventions: intracellular signaling and induced proximity. Trends Biochem Sci. Nov. 1996;21(11):418-22. doi: 10.1016/s0968-0004(96)20027-1.

Crick, On protein synthesis. Symp Soc Exp Biol. 1958;12:138-63.

Crystal, Transfer of genes to humans: early lessons and obstacles to success. Science. Oct. 20, 1995;270(5235):404-10. doi: 10.1126/science.270.5235.404.

Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.

Dass A et al., Trans protein splicing of cyanobacterial split inteins in endogenous and exogenous combinations. Biochemistry. Jan. 9, 2007;46(1):322-30. doi: 10.1021/bi0611762.

DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.

Delebecque et al., Organization of intracellular reactions with rationally designed RNA assemblies. Science. Jul. 22, 2011;333(6041):470-4. doi: 10.1126/science.1206938. Epub Jun. 23, 2011.

Dickey et al., Single-stranded DNA-binding proteins: multiple domains for multiple functions. Structure. Jul. 2, 2013;21(7):1074-84. doi: 10.1016/j.str.2013.05.013.

Dillon, Regulating gene expression in gene therapy. Trends Biotechnol. May 1993;11(5):167-73. doi: 10.1016/0167-7799(93)90109-M.

Dingwall et al., Nuclear targeting sequences—a consensus? Trends Biochem Sci. Dec. 1991;16(12):478-81. doi: 10.1016/0968-0004(91)90184-w.

Diver et al., Single-Step Synthesis of Cell-Permeable Protein Dimerizers That Activate Signal Transduction and Gene Expression. J. Am. Chem. Soc. Jun. 4, 1997; 119(22):5106-5109. https://doi.org/10.1021/ja963891c.

Dominissini et al., Topology of the human and mouse m6A RNA methylomes revealed by m6A-seq. Nature. Apr. 29, 2012;485(7397):201-6. doi: 10.1038/nature11112.

Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.

Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

Dunbar et al., Gene therapy comes of age. Science. Jan. 12, 2018;359(6372):eaan4672. doi: 10.1126/science.aan4672.

Dupuy et al., Le syndrome de De La Chapelle [De La Chapelle syndrome]. Presse Med. Mar. 3, 2001;30(8):369-72. French.

Edlund et al., Cell-specific expression of the rat insulin gene: evidence for role of two distinct 5' flanking elements. Science. Nov. 22, 1985;230(4728):912-6. doi: 10.1126/science.3904002.

England, Unnatural amino acid mutagenesis: a precise tool for probing protein structure and function. Biochemistry. Sep. 21, 2004;43(37):11623-9.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003.

(56) References Cited

OTHER PUBLICATIONS

Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Filippov et al., A novel type of RNase III family proteins in eukaryotes. Gene. Mar. 7, 2000;245(1):213-21. doi: 10.1016/s0378-1119(99)00571-5.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

Forster et al., Self-cleavage of virusoid RNA is performed by the proposed 55-nucleotide active site. Cell. Jul. 3, 1987;50(1):9-16. doi: 10.1016/0092-8674(87)90657-x.

Gaj et al., 3rd. Genome engineering with custom recombinases. Methods Enzymol. 2014;546:79-91. doi: 10.1016/B978-0-12-801185-0.00004-0.

Gao et al., Cationic liposome-mediated gene transfer. Gene Ther. Dec. 1995;2(10):710-22.

Gao et al., Prime editing in mice reveals the essentiality of a single base in driving tissue-specific gene expression. Genome Biol. Mar. 16, 2021;22(1):83. doi: 10.1186/s13059-021-02304-3.

Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.

Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.

Gibson et al., Enzymatic assembly of DNA molecules up to several hundred kilobases. Nat Methods. May 2009;6(5):343-5. doi: 10.1038/nmeth.1318. Epub Apr. 12, 2009.

Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.

Gumulya et al., Exploring the past and the future of protein evolution with ancestral sequence reconstruction: the 'retro' approach to protein engineering. Biochem J. Jan. 1, 2017;474( 1):1-19. doi: 10.1042/BCJ20160507.

Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.

Guo et al., Facile functionalization of FK506 for biological studies by the thiol-ene 'click' reaction. RSC Advances. 2014;22:11400-3.

Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.

Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.

Haddada et al., Gene therapy using adenovirus vectors. Curr Top Microbiol Immunol. 1995; 199 ( Pt 3):297-306. doi: 10.1007/978-3-642-79586-2_14.

Hanna et al., Massively parallel assessment of human variants with base editor screens. Cell. Feb. 18, 2021;184(4):1064-1080.e20. doi: 10.1016/j.cell.2021.01.012.

Hector et al., CDKL5 variants: Improving our understanding of a rare neurologic disorder. Neurol Genet. Dec. 15, 2017;3(6):e200. doi: 10.1212/NXG.0000000000000200.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Hsu et al., PrimeDesign software for rapid and simplified design of prime editing guide RNAs. Nat Commun. Feb. 15, 2021;12(1):1034. doi: 10.1038/s41467-021-21337-7.

Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.

Huggins et al., Flap endonuclease 1 efficiently cleaves base excision repair and DNA replication intermediates assembled into nucleosomes. Mol Cell. Nov. 2002;10(5):1201-11. doi: 10.1016/81097-2765(02)00736-0.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jeggo, DNA breakage and repair. Adv Genet. 1998;38:185-218. doi: 10.1016/s0065-2660(08)60144-3.

Jiang et al., Chemical modifications of adenine base editor mRNA and guide RNA expand its application scope. Nat Commun. Apr. 24, 2020;11(1):1979. doi: 10.1038/s41467-020-15892-8.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

(56) References Cited

OTHER PUBLICATIONS

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Keravala et al., A diversity of serine phage integrases mediate site-specific recombination in mammalian cells. Mol Genet Genomics. Aug. 2006;276(2): 135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.

Kim et al., An anionic human protein mediates cationic liposome delivery of genome editing proteins into mammalian cells. Nat Commun. Jul. 2, 2019;10(1):2905. doi: 10.1038/s41467-019-10828-3.

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.

Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.

Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.

Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.

Kolot et al., Site-specific recombination in mammalian cells expressing the Int recombinase of bacteriophage HK022. Mol Biol Rep. Aug. 1999;26(3):207-13. doi: 10.1023/a:1007096701720.

Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.

Kotewicz et al., Cloning and overexpression of Moloney murine leukemia virus reverse transcriptase in *Escherichia coli*. Gene. 1985;35(3):249-58. doi: 10.1016/0378-1119(85)90003-4.

Kotin, Prospects for the use of adeno-associated virus as a vector for human gene therapy. Hum Gene Ther. Jul. 1994;5(7):793-801. doi: 10.1089/hum.1994.5.7-793.

Kremer et al., Adenovirus and adeno-associated virus mediated gene transfer. Br Med Bull. Jan. 1995;51(1):31-44. doi: 10.1093/oxfordjournals.bmb.a072951.

Krokan et al., Uracil in DNA—occurrence, consequences and repair. Oncogene. Dec. 16, 2002;21(58):8935-48. doi: 10.1038/sj.onc.1205996.

Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.

Kunkel et al., Eukaryotic Mismatch Repair in Relation to DNA Replication. Annu Rev Genet. 2015;49:291-313. doi: 10.1146/annurev-genet-l 12414-054722.

Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Lakich et al., Inversions disrupting the factor VIII gene are a common cause of severe haemophilia A. Nat Genet. Nov. 1993;5(3):236-41. doi: 10.1038/ng1193-236.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Lapinaite et al., DNA capture by a CRISPR-Cas9-guided adenine base editor. Science. Jul. 31, 2020;369(6503):566-571. doi: 10.1126/science.abb1390.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., Simultaneous targeting of linked loci in mouse embryos using base editing. Sci Rep. Feb. 7, 2019;9(1):1662. doi: 10.1038/s41598-018-33533-5.

Lee et al., Targeted chromosomal deletions in human cells using zinc finger nucleases. Genome Res. Jan. 20, 2020: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Loss of post-translational modification sites in disease. Pac Symp Biocomput. 2010:337-47. doi: 10.1142/9789814295291_0036.

Li et al., RSEM: accurate transcript quantification from RNA-Seq data with or without a reference genome. BMC Bioinformatics. Aug. 4, 2011;12:323. doi: 10.1186/1471-2105-12-323.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Lin et al., Prime genome editing in rice and wheat. Nat Biotechnol. May 2020;38(5):582-585. doi: 10.1038/s41587-020-0455-x. Epub Mar. 16, 2020.

Liu et al., Adding new chemistries to the genetic code. Annu Rev Biochem. 2010;79:413-44. doi: 10.1146/annurev.biochem.052308.105824.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., Flap endonuclease 1: a central component of DNA metabolism. Annu Rev Biochem. 2004;73:589-615. doi: 10.1146/annurev.biochem.73.012803.092453.

Liu et al., Genetic incorporation of unnatural amino acids into proteins in mammalian cells. Nat Methods. Mar. 2007;4(3):239-44. Epub Feb. 25, 2007.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

(56) References Cited

OTHER PUBLICATIONS

Luckow et al., High level expression of nonfused foreign genes with Autographa califomica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Maji et al., A High-Throughput Platform to Identify Small-Molecule Inhibitors of CRISPR-Cas9. Cell. May 2, 2019;177(4):1067-1079. e19. doi: 10.1016/j.cell.2019.04.009.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Marquart et al., Predicting base editing outcomes with an attention-based deep learning algorithm trained on high-throughput target library screeen. bioRxiv. Jul. 5, 2020. DOI:10.1101/2020.07.05. 186544. Retrieved from the Internet via https://www.biorxiv.org/content/10.1101/2020.07.05.186544v1.full.pdf lased accessed on Apr. 28, 2021.

Martsolf et al., Complete trisomy 17p a relatively new syndrome. Ann Genet. 1988;31(3):172-4.

Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.

McCarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

Meinke et al., Cre Recombinase and Other Tyrosine Recombinases. Chem Rev. Oct. 26, 2016;116(20):12785-12820. doi: 10.1021/acs. chemrev.6b00077. Epub May 10, 2016.

Michel et al., Mitochondrial class II introns encode proteins related to the reverse transcriptases of retroviruses. Nature. Aug. 15-21, 1985;316(6029):641-3. doi: 10.1038/316641a0.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Miller, Human gene therapy comes of age. Nature. Jun. 11, 1992;357(6378):455-60. doi: 10.1038/357455a0.

Mitani et al., Delivering therapeutic genes—matching approach and application. Trends Biotechnol. May 1993;11(5):162-6. doi: 10.1016/0167-7799(93)90108-L.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.

Myers et al., Insulin signal transduction and the IRS proteins. Annu Rev Pharmacol Toxicol. 1996;36:615-58. doi: 10.1146/annurev.pa. 36.040196.003151.

Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.

Newby et al., Base editing of haematopoietic stem cells rescues sickle cell disease in mice. Nature. Jun. 2, 2021. doi: 10.1038/s41586-021-03609-w. Epub ahead of print.

Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.

Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.

Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.

Olorunniji et al., Purification and In Vitro Characterization of Zinc Finger Recombinases. Methods Mol Biol. 2017;1642:229-245. doi: 10.1007/978-1-4939-7169-5_15.

Olorunniji et al., Site-specific recombinases: molecular machines for the Genetic Revolution. Biochem J. Mar. 15, 2016;473(6):673-84. doi: 10.1042/BJ20151112.

Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.

Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.

Ostertag et al., Biology of mammalian L1 retrotransposons. Annu Rev Genet. 2001;35:501-38. doi: 10.1146/annurev.genet.35.102401. 091032.

Otomo et al., Improved segmental isotope labeling of proteins and application to a larger protein. J Biomol NMR. Jun. 1999;14(2):105-14. doi: 10.1023/a:1008308128050.

Otomo et al., NMR observation of selected segments in a larger protein: central-segment isotope labeling through intein-mediated ligation. Biochemistry. Dec. 7, 1999;38(49):16040-4. doi: 10.1021/bi991902j.

Packer et al., Methods for the directed evolution of proteins. Nat Rev Genet. Jul. 2015;16(7):379-94. doi: 10.1038/nrg3927. Epub Jun. 9, 2015.

Packer et al., Phage-assisted continuous evolution of proteases with altered substrate specificity. Nat Commun. Oct. 16, 2017;8(1):956. doi: 10.1038/s41467-017-01055-9.

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.

Perler et al., Protein splicing and autoproteolysis mechanisms. Curr Opin Chem Biol. Oct. 1997;1(3):292-9. doi: 10.1016/s1367-5931(97)80065-8.

(56) References Cited

OTHER PUBLICATIONS

Popp et al., Sortagging: a versatile method for protein labeling. Nat Chem Biol. Nov. 2007;3(11):707-8. doi: 10.1038/nchembio.2007.31. Epub Sep. 23, 2007.
Pruschy et al., Mechanistic studies of a signaling pathway activated by the organic dimerizer FK1012. Chem Biol. Nov. 1994;1(3):163-72. doi: 10.1016/1074-5521(94)90006-x.
Queen et al., Immunoglobulin gene transcription is activated by downstream sequence elements. Cell. Jul. 1983;33(3):741-8. doi: 10.1016/0092-8674(83)90016-8.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Ramamurthy et al., Identification of immunogenic B-cell epitope peptides of rubella virus E1 glycoprotein towards development of highly specific immunoassays and/or vaccine. Conference Abstract. 2019.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Remy et al., Gene transfer with a series of lipophilic DNA-binding molecules. Bioconjug Chem. Nov.-Dec. 1994;5(6):647-54. doi: 10.1021/bc00030a021.
Richter et al.,. Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robinson et al., The protein tyrosine kinase family of the human genome. Oncogene. Nov. 20, 2000;19(49):5548-57. doi: 10.1038/sj.onc.1203957.
Rowley, Chromosome translocations: dangerous liaisons revisited. Nat Rev Cancer. Dec. 2001;1(3):245-50. doi: 10.1038/35106108.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Sadowski, The Flp recombinase of the 2-microns plasmid of *Saccharomyces cerevisiae*. Prog Nucleic Acid Res Mol Biol. 1995;51:53-91.
Saha et al., The NIH Somatic Cell Genome Editing program. Nature. Apr. 2021;592(7853):195-204. doi: 10.1038/s41586-021-03191-1. Epub Apr. 7, 2021.
Sarkar et al., HIV-1 pro viral DNA excision using an evolved recombinase. Science. Jun. 29, 2007;316(5833):1912-5. doi: 10.1126/science.1141453.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Seed, An LFA-3 cDNA encodes a phospholipid-linked membrane protein homologous to its receptor CD2. Nature. Oct. 29-Nov 4, 1987;329(6142):840-2. doi: 10.1038/329840a0.
Setten et al., The current state and future directions of RNAi-based therapeutics. Nat Rev Drug Discov. Jun. 2019;18(6):421-446. doi: 10.1038/s41573-019-0017-4.
Sha et al., Monobodies and other synthetic binding proteins for expanding protein science. Protein Sci. May 2017;26(5):910-924. doi: 10.1002/pro.3148. Epub Mar. 24, 2017.
Shingledecker et al., Molecular dissection of the *Mycobacterium tuberculosis* Rec A intein: design of a minimal intein and of a trans-splicing system involving two intein fragments. Gene. Jan. 30, 1998;207(2):187-95. doi: 10.1016/s0378-1119(97)00624-0.
Singh et al., Real-time observation of DNA recognition and rejection by the RNA-guided endonuclease Cas9. Nat Commun. Sep. 14, 2016;7:12778. doi: 10.1038/ncomms12778.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Sommerfelt et al., Receptor interference groups of 20 retroviruses plating on human cells. Virology. May 1990;176(1):58-69. doi: 10.1016/0042-6822(90)90230-o.
Spencer et al., Controlling signal transduction with synthetic ligands. Science. Nov. 12, 1993;262(5136):1019-24. doi: 10.1126/science.7694365.
Stadtman, Selenocysteine. Annu Rev Biochem. 1996;65:83-100.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Thomson et al., Mutational analysis of loxP sites for efficient Cre-mediated insertion into genomic DNA. Genesis. Jul. 2003;36(3):162-7. doi: 10.1002/gene.10211.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
UniProtein A0A1V6. Dec. 11, 2019.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.

(56) References Cited

OTHER PUBLICATIONS

Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Wang et al., Expanding the genetic code. Annu Rev Biophys Biomol Struct. 2006;35:225-49. Review.
Wang et al., Highly efficient CRISPR/HDR-mediated knock-in for mouse embryonic stem cells and zygotes. Biotechniques. 2015:59,201-2;204;206-8.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wood et al., A genetic system yields self-cleaving inteins for bioseparations. Nat Biotechnol. Sep. 1999;17(9):889-92. doi: 10.1038/12879.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Yamazaki et al., Segmental Isotope Labeling for Protein NMR Using Peptide Splicing. J. Am. Chem. Soc. May 22, 1998; 120(22):5591-2. https://doi.org/10.1021/ja980776o.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Yu et al., Progress towards gene therapy for HIV infection. Gene Ther. Jan. 1994;1(1):13-26.
Zhang et al., A new strategy for the site-specific modification of proteins in vivo. Biochemistry. Jun. 10, 2003;42(22):6735-46.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zheng et al., Structural basis for the complete resistance of the human prion protein mutant G127V to prion disease. Sci Rep. Sep. 4, 2018;8(1):13211. doi: 10.1038/s41598-018-31394-6.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Zielenski, Genotype and phenotype in cystic fibrosis. Respiration. 2000;67(2):117-33. doi: 10.1159/000029497.
U.S. Appl. No. 61/874,746, filed Sep. 6, 2013, Liu et al.
U.S. Appl. No. 61/874,682, filed Sep. 6, 2013, Liu et al.
U.S. Appl. No. 61/838,178, filed Jun. 21, 2013, Joung et al.
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
U.S. Appl. No. 62/357,332, filed Jun. 30, 2016, Liu et al.
U.S. Appl. No. 62/288,661, filed Jan. 29, 2016, Muir et al.
[No Author Listed] "FokI" from New England Biolabs Inc. Last accessed online via https://www.neb.com/products/r0109-foki#Product%20Information on Mar. 19, 2021. 1 page.
[No Author Listed] "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C ->U editing enzyme APOBEC-1 [Peromyscus maniculatus bairdii], XP002793540, Mar. 2019.
[No Author Listed] NCBI Accession No. XP_021505673.1. C ->U editing enzyme APOBEC-1 [Meriones unguiculatus], XP002793541, Apr. 2019.
[No Author Listed] Score result for SEQ 355 to W02017032580. Muir et al. 2016.

(56) References Cited

OTHER PUBLICATIONS

[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Aihara et al., A conformational switch controls the DNA cleavage activity of lambda integrase. Mol Cell. Jul. 2003; 12(1):187-98.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Akinsheye et al., Fetal hemoglobin in sickle cell anemia. Blood. Jul. 7, 2011; 118(1):19-27. doi: 10.1182/blood-2011-03-325258. Epub Apr. 13, 2011.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.

Amato et al., Interpreting elevated fetal hemoglobin in pathology and health at the basic laboratory level: new and known ?—gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.

(56) References Cited

OTHER PUBLICATIONS

Bae et al., Microhomology-based choice of Cas9 nuclease target sites. Nat Methods. Jul. 2014;11(7):705-6. doi: 10.1038/nmeth.3015.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartoso Vic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Beumer et al., Efficient gene targeting in *Drosophila* with zinc-finger nucleases. Genetics. Apr. 2006;172(4):2391-403. Epub Feb. 1, 2006.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blain et al., Nuclease activities of Moloney murine leukemia virus reverse transcriptase. Mutants with altered substrate specificities. J Biol Chem. Nov. 5, 1993;268(31):23585-92.
Blau et al., A proliferation switch for genetically?modified?cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Böck et al., Selenocysteine: the 21st amino acid. Mol Microbiol. Mar. 1991;5(3):515-20.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA

(56) References Cited

OTHER PUBLICATIONS as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Borchardt et al., Controlling mRNA stability and translation with the CRISPR endoribonuclease Csy4. RNA. Nov. 2015;21(11): 1921-30. doi: 10.1261/rna.051227.115. Epub Sep. 9, 2015.
Borman, Improved route to single-base genome editing. Chemical & Engineering News, Apr. 25, 2016;94(17)p. 5. http://cen.acs.org/articles/94/i17/Improved-route-single-base-genome.html.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611860310001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013; 1010:3-17. doi: 10.1007/978-1-62703-411-1_1.

Bulow et al., Multienzyme systems obtained by gene fusion. Trends Biotechnol. Jul. 1991;9(7):226-31.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Cargill et al. Characterization of single-nucleotide polymorphisms in coding regions of human genes. Nat Genet. Jul. 1999;22(3):231-8.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22): 1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

(56) References Cited

OTHER PUBLICATIONS

Cermak et al., Efficient design and assembly of custom TALEN and other TAL effectorbased constructs for DNA targeting. Nucleic Acids Res. Jul. 2011;39(12):e82. Doi: 10.1093/nar/gkr218. Epub Apr. 14, 2011.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chadwick et al., In Vivo Base Editing of PCSK9 (Proprotein Convertase Subtilisin/Kexin Type 9) as a Therapeutic Alternative to Genome Editing. Arterioscler Thromb Vase Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 16, 2016.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chapman et al., Playing the end game: DNA double-strand break repair pathway choice. Mol Cell. Aug. 24, 2012;47(4):497-510. doi: 10.1016/j.molcel.2012.07.029.

Charpentier et al., Biotechnology: Rewriting a genome. Nature. Mar. 7, 2013;495(7439):50-1.doi: 10.1038/495050a.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Highly efficient Cas9-mediated transcriptional programming. Nat Methods. Apr. 2015; 12(4):326-8. doi: 10.1038/nmeth.3312. Epub Mar. 2, 2015.

Chavez et al., Precise Cas9 targeting enables genomic mutation prevention. bioRxiv. Jun. 14, 2016; http://dx/doi.oreg/10.1101/058974. 6 pages.

Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018. bioRxiv preprint first posted online Jun. 14, 2016.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.

Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.

Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chesnoy et al., Structure and function of lipid-DNA complexes for gene delivery. Annu Rev Biophys Biomol Struct. 2000;29:27-47.

Chew et al., A multifunctional AAV-CRISPR-Cas9 and its host response. Nat Methods. Oct. 2016;13(10):868-74. doi: 10.1038/nmeth.3993. Epub Sep. 5, 2016. With Supplementary Information.

Chichili et al., Linkers in the structural biology of protein-protein interactions. Protein Science. 2013;22:153-67.

Chin, Expanding and reprogramming the genetic code of cells and animals. Annu Rev Biochem. 2014;83:379-408. doi: 10.1146/annurev-biochem-060713-035737. Epub Feb. 10, 2014.

Chipev et al., A leucine—proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Site-specific recombination of bacteriophage P22 does not require integration host factor. J Bacteriol. Jul. 1999;181(14):4245-9. doi: 10.1128/JB.181.14.4245-4249.1999.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.

Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.

Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.

Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.

Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.

Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.

Choudhury et al., Engineering RNA endonucleases with customized sequence specificities. Nat Commun. 2012;3:1147. doi: 10.1038/ncomms2154.

Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christian et al., Targeting DNA double-strand breaks with TAL effector nucleases. Genetics. Oct. 2010;186(2):757-61. Doi: 10.1534/genetics.ll0.120717. Epub Jul. 26, 2010.

Christiansen et al., Characterization of the lactococcal temperate phage TP901-1 and its site-specific integration. J Bacteriol. Feb. 1994;176(4):1069-76. doi: 10.1128/jb.176.4.1069-1076.1994.

Chuai et al., DeepCRISPR: optimized CRISPR guide RNA design by deep learning. Genome Biol. Jun. 26, 2018;19(1):80. doi: 10.1186/s13059-018-1459-4.

Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.

Chuang et al., Novel Heterotypic Rox Sites for Combinatorial Dre Recombination Strategies. G3 (Bethesda). Dec. 29, 2015;6(3):559-71. doi: 10.1534/g3.115.025841.

Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.

Chung-Il et al., Artificial control of gene expression in mammalian cells by modulating RNA interference through aptamer-small molecule interaction. RNA. May 2006;12(5):710-6. Epub Apr. 10, 2006.

(56) References Cited

OTHER PUBLICATIONS

Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.
Cokol et al., Finding nuclear localization signals. EMBO Rep. Nov. 2000;1(5):411-5. doi: 10.1093/embo-reports/kvd092.
Cole-Strauss et al., Correction of the mutation responsible for sickle cell anemia by an RNA-DNA oligonucleotide. Science. Sep. 6, 1996;273(5280):1386-9.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011512171109 17.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.cehep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.

Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gkul010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dang et al., Optimizing sgRNA structure to improve CRISPR-Cas9 knockout efficiency. Genome Biol. Dec. 15, 2015;16:280. doi: 10.1186/s13059-015-0846-3.
Das et al.,The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Datsenko et al., One-step inactivation of chromosomal genes in *Escherichia coli* K-12 using PCR products. Proc Natl Acad Sci U S A. Jun. 6, 2000;97(12):6640-5.
Davis et al., DNA double strand break repair via non-homologous end-joining. Transl Cancer Res. Jun. 2013;2(3):130-143.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.

(56) References Cited

OTHER PUBLICATIONS

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.

Dickinson et al., Experimental interrogation of the path dependence and stochasticity of protein evolution using phage-assisted continuous evolution. Proc Natl Acad Sci U S A. May 2013;110(22):9007-12.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.

Dixon et al., Reengineering orthogonally selective riboswitches. Proc Natl Acad Sci U S A. Feb. 16, 2010; 107(7):2830-5. doi: 10.1073/pnas.0911209107. Epub Jan. 26, 2010.

Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.

Dormiani et al., Long-term and efficient expression of human ?-globin gene in a hematopoietic cell line using a new site-specific integrating non-viral system. Gene Ther. Aug. 2015;22(8):663-74. doi: 10.1038/gt.2015.30. Epub Apr. 1, 2015.

Doudna et al., Genome editing. The new frontier of genome engineering with CRISPR-Cas9. Science. Nov. 28, 2014;346(6213):1258096. doi: 10.1126/science.1258096.

Dove et al., Conversion of the omega subunit of *Escherichia coli* RNA polymerase into a transcriptional activator or an activation target. Genes Dev. Mar. 1, 1998;12(5):745-54.

Doyon et al., Directed evolution and substrate specificity profile of homing endonuclease I-SceI. J Am Chem Soc. Feb. 22, 2006;128(7):2477-84.

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.

Drake, A constant rate of spontaneous mutation in DNA-based microbes. Proc Natl Acad Sci U S A. Aug. 15, 1991;88(16):7160-4.

Dubois et al., Retroviral RNA Dimerization: From Structure to Functions. Front Microbiol. Mar. 22, 2018;9:527. doi: 10.3389/fmicb.2018.00527.

Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.

Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.

Durai et al., A bacterial one-hybrid selection system for interrogating zinc finger-DNA interactions. Comb Chem High Throughput Screen. May 2006;9(4):301-11.

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

During et al., Controlled release of dopamine from a polymeric brain implant: in vivo characterization. Ann Neurol. Apr. 1989;25(4):351-6.

East-Seletsky et al., Two distinct RNase activities of CRISPR-C2c2 enable guide-RNA processing and RNA detection. Nature Oct. 2016;538(7624):270-3.

Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.

Edwards et al., Crystal structures of the thi-box riboswitch bound to thiamine pyrophosphate analogs reveal adaptive RNA-small molecule recognition. Structure. Sep. 2006; 14(9):1459-68.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014; 111(36):13028-33. doi: 10.1073/pnas.1414571111. Epub Aug. 25, 2014.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Endo et al., Toward establishing an efficient and versatile gene targeting system in higher plants. Biocatalysis and Agricultural Biotechnology 2014;3,(1):2-6.

Engel et al., The emerging role of mRNA methylation in normal and pathological behavior. Genes Brain Behav. Mar. 2018;17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Esvelt et al., A system for the continuous directed evolution of biomolecules. Nature. Apr. 28, 2011;472(7344):499-503. doi: 10.1038/nature09929. Epub Apr. 10, 2011.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 28, 2013.

Evans et al., Protein trans-splicing and cyclization by a naturally split intein from the dnaE gene of Synechocystis species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Fagerlund et al., The Cpf1 CRISPR-Cas protein expands genome-editing tools. Genome Biology Nov. 17, 2015;16:251. https://doi.org/10.1186/s13059-015-0824-9.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fang et al., Synthetic Studies Towards Halichondrins: Synthesis of the Left Halves of Norhalichondrins and Homohalichondrins. Tetrahedron Letters 1992;33(12):1557-1560.

Farhood et al., Codelivery to mammalian cells of a transcriptional factor with cis-acting element using cationic liposomes. Anal Biochem. Feb. 10, 1995;225(1):89-93.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

(56) References Cited

OTHER PUBLICATIONS

Feng et al., Human L1 retrotransposon encodes a conserved endonuclease required for retrotransposition. Cell. Nov. 29, 1996;87(5):905-16. doi: 10.1016/s0092-8674(00)81997-2.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Feuk, Inversion variants in the human genome: role in disease and genome architecture. Genome Med. Feb. 12, 2010;2(2):11. doi: 10.1186/gm132.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Fogg et al., New applications for phage integrases. J Mol Biol. Jul. 29, 2014;426(15):2703-16. doi: 10.1016/j.jmb.2014.05.014. Epub May 22, 2014.
Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005; 14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garibyan et al., Use of the rpoB gene to determine the specificity of base substitution mutations on the *Escherichia coli chromosome*. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E. coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
Genbank Submission; NIH/NCBI Accession No. NM_001319224.2. Umar et al., Apr. 21, 2021. 7 pages.
Genbank Submission; NIH/NCBI Accession No. NM_006027.4. Umar et al., Apr. 10, 2021. 7 pages.
Genbank Submission; NIH/NCBI, Accession No. AAA66622.1. Martinelli et al., May 18, 1995. 2 pages.
Genbank Submission; NIH/NCBI, Accession No. AGT42196. Farzadfar et al., Nov. 2, 2013. 2 pages.
Genbank Submission; NIH/NCBI, Accession No. APG80656.1. Burstein et al., Dec. 10, 2016. 1 pages.
Genbank Submission; NIH/NCBI, Accession No. AYD60528.1. Ram et al., Oct. 2, 2018. 1 page.
Genbank Submission; NIH/NCBI, Accession No. J04623. Kita et al., Apr. 26, 1993. 2 pages.
Genbank Submission; NIH/NCBI, Accession No. KR710351.1. Sahni et al., Jun. 1, 2015. 2 pages.

(56) References Cited

OTHER PUBLICATIONS

Genbank Submission; NIH/NCBI, Accession No. NC 002737.2. Nasser et al., Feb. 7, 2021. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NM_000311.5. Alves et al., Mar. 7, 2021. 5 pages.
Genbank Submission; NIH/NCBI, Accession No. NM_001319224. Umar et al., Apr. 21, 2021. 7 pages.
Genbank Submission; NIH/NCBI, Accession No. NM_003686. Umar et al., Apr. 9, 2021. 7 pages.
Genbank Submission; NIH/NCBI, Accession No. NM_006027. Umar et al., Apr. 10, 2021. 7 pages.
Genbank Submission; NIH/NCBI, Accession No. NM_174936. Guo et al., Oct. 28, 2015. 6 pages.
Genbank Submission; NIH/NCBI, Accession No. NP_000302.1. Alves et al., Mar. 7, 2021. 4 pages.
Genbank Submission; NIH/NCBI, Accession No. NP_472073.1. Glaser et al., Jun. 27, 2013. 2 pages.
Genbank Submission; NIH/NCBI, Accession No. NP_955579.1. Chen et al., Aug. 13, 2018. 5 pages.
Genbank Submission; NIH/NCBI, Accession No. P42212. Prasher et al., Mar. 19, 2014. 7 pages.
Genbank Submission; NIH/NCBI, Accession No. QBJ66766. Duan et al. Aug. 12, 2020. 2 pages.
Genbank Submission; NIH/NCBI, Accession No. RFF81513.1. Zhou et al., Aug. 21, 2018. 2 pages.
Genbank Submission; NIH/NCBI, Accession No. SNX31424.1. Weckx, S., Feb. 16, 2018. 2 pages.
Genbank Submission; NIH/NCBI, Accession No. TGH57013. Xu et al., Apr. 9, 2019. 2 pages.
Genbank Submission; NIH/NCBI, Accession No. WP_016631044. 1. Haft et al., Sep. 22, 2020. 1 page.
Genbank Submission; NIH/NCBI, Accession No. WP_031386437. No Author Listed., Sep. 23, 2019. 1 page.
Genbank Submission; NIH/NCBI, Accession No. WP_0315 89969. 1. Haft et al., Oct. 9, 2019. 2 pages.
Genbank Submission; NIH/NCBI, Accession No. WP_044924278. 1. Haft et al., Oct. 9, 2019. 2 pages.
Genbank Submission; NIH/NCBI, Accession No. WP_047338501. 1. Haft et al., Oct. 9, 2019. 2 pages.
Genbank Submission; NIH/NCBI, Accession No. WP_060798984. 1. Haft et al., Oct. 9, 2019. 2 pages.
Genbank Submission; NIH/NCBI, Accession No. WP_062913273. 1. Haft et al., Oct. 9, 2019, 2 pages.
Genbank Submission; NIH/NCBI, Accession No. WP_072754838. No Author Listed., Sep. 23, 2019. 1 page.
Genbank Submission; NIH/NCBI, Accession No. WP_095142515. 1. No Author Listed., Sep. 23, 2019. 1 page.
Genbank Submission; NIH/NCBI, Accession No. WP_118538418. 1. No Author Listed., Oct. 13, 2019. 1 page.
Genbank Submission; NIH/NCBI, Accession No. WP_119223642. 1. No Author Listed., Oct. 13, 2019. 1 page.
Genbank Submission; NIH/NCBI, Accession No. WP_119227726. 1. No Author Listed., Oct. 13, 2019. 1 page.
Genbank Submission; NIH/NCBI, Accession No. WP_119623382. 1. No Author Listed., Oct. 13, 2019. 1 page.
Genbank Submission; NIH/NCBI, Accession No. WP_132221894. 1. No Author Listed., Sep. 23, 2019. 1 page.
Genbank Submission; NIH/NCBI, Accession No. WP_133478044. 1. Haft et al., Oct. 9, 2019. 2 pages.
Genbank Submission; NIH/NCBI, Accession No. YP_002342100. 1. Bernardini et al., Jun. 10, 2013. 2 pages.
Genbank Submission; NIH/NCBI, Accession No. YP_002344900. 1. Gundogdu et al., Mar. 19, 2014. 2 pages.
Genbank Submission; NIH/NCBI, Accession No. YP_009283008. 1. Bernardini et al., Sep. 23, 2016. 2 pages.
Genbank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Purification and characterization of the DNA polymerase and RNase H activities in Moloney murine sarcoma-leukemia virus. J Virol. Apr. 1975;15(4):785-97. doi: 10.1128/JVI. 15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/ekr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al., DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014. 05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.

(56) References Cited

OTHER PUBLICATIONS

Grainge et al., The integrase family of recombinase: organization and function of the active site. Mol Microbiol. Aug. 1999;33(3):449-56.
Gregory et al., Integration site for Streptomyces phage phiBT1 and development of sitespecific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/gb-2001-2-6-reviews1017. Epub Jun. 5, 2001.
Grishok et al., Genes and Mechanisms Related to RNA Interference Regulate Expression of the Small Temporal RNAs that Control C. elegans Developmental Timing. Jul. 13, 2001:106(1):P23-4.
Groth et al., Construction of transgenic *Drosophila* by using the site-specific integrase from phage phiC31. Genetics. Apr. 2004;166(4):1775-82. doi: 10.1534/genetics.166.4.1775.
Gruber et al., Strategies for measuring evolutionary conservation of RNA secondary structures. BMC Bioinformatics. Feb. 26, 2008;9:122. doi: 10.1186/1471-2105-9-122.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Harms et al., Evolutionary biochemistry: revealing the historical and physical causes of protein properties. Nat Rev Genet. Aug. 2013;14(8):559-71. doi: 10.1038/nrg3540.
Harrington et al., A thermostable Cas9 with increased lifetime in human plasma. Nat Commun. Nov. 10, 2017;8(1):1424. doi: 10.1038/s41467-017-01408-4.
Harris et al., RNA Editing Enzyme APOBEC 1 and Some of Its Homologs Can Act as DNA Mutators. Mol Cell. Nov. 2002; 10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendricks et al., The S. cerevisiae Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.

(56) References Cited

OTHER PUBLICATIONS

Hirano et al., Structural Basis for the Altered PAM Specificities of Engineered CRISPR-Cas9. Mol Cell. Mar. 17, 2016;61(6):886-94. doi: 10.1016/j.molcel.2016.02.018.

Hoang et al., UFBoot2: Improving the Ultrafast Bootstrap Approximation. Mol Biol Evol. Feb. 1, 2018;35(2):518-522. doi: 10.1093/molbev/msx281.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Hoernes et al., Translating the epitranscriptome. Wiley Interdiscip Rev RNA. Jan. 2017;8(1):e1375. doi: 10.1002/wrna.1375. Epub Jun. 27, 2016.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hollis et al., Phage integrases for the construction and manipulation of transgenic mammals. Reprod Biol Endocrinol. Nov. 7, 2003;1:79. doi: 10.1186/1477-7827-1-79.

Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.

Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol Chem Oct. 2011; 286(50):43112-22. doi: 10.1074/jbc.M111.252775.

Hoogenboom et al., Natural and designer binding sites made by phage display technology. Immunol Today. Aug. 2000;21(8):371-8.

Horvath et al., CRISPR/Cas, the immune system of bacteria and archaea. Science. Jan. 8, 2010;327(5962):167-70. doi: 10.1126/science.1179555.

Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houdebine, The methods to generate transgenic animals and to control transgene expression. J Biotechnol. Sep. 25, 2002;98(2-3):145-60.

Howard et al., Intracerebral drug delivery in rats with lesion-induced memory deficits. J Neurosurg. Jul. 1989;71(1):105-12.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Hu et al., Evolved Cas9 variants with broad PAM compatibility and high DNA specificity. Nature. Apr. 5, 2018;556(7699):57-63. doi: 10.1038/nature26155. Epub Feb. 28, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huang et al., Heritable gene targeting in zebrafish using customized TALENs. Nat Biotechnol. Aug. 5, 2011;29(8):699-700. doi: 10.1038/nbt.1939.

Humbert et al., Targeted gene therapies: tools, applications, optimization. Crit Rev Biochem Mol Biol. May-Jun. 2012;47(3):264-81. doi: 10.3109/10409238.2012.658112.

Hung et al., Protein localization in disease and therapy. J Cell Sci. Oct. 15, 2011;124(Pt 20):3381-92. doi: 10.1242/jcs.089110.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Husimi, Selection and evolution of bacteriophages in cellstat. Adv Biophys. ; 1989;25:1-43. Review.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Iida et al., A site-specific, conservative recombination system carried by bacteriophage P1. Mapping the recombinase gene cin and the cross-over sites cix for the inversion of the C segment. EMBO J. 1982;1(11):1445-53.

Ikediobi et al., Mutation analysis of 24 known cancer genes in the NCI-60 cell line set. Mol Cancer Ther. Nov. 2006;5(11):2606-12. Epub Nov. 6, 2006.

Imburgio et al., Studies of promoter recognition and start site selection by T7 RNA polymerase using a comprehensive collection of promoter variants. Biochemistry. Aug. 29, 2000;39(34):10419-30.

International Search Report and Written Opinion for PCT/US2020/023721, dated Jun. 23, 2020.

Invitation to Pay Additional Fees for PCT/US2020/023553, dated Sep. 14, 2020.

International Search Report and Written Opinion for PCT/US2020/023553, dated Nov. 6, 2020.

International Search Report and Written Opinion for PCT/US2020/023583, dated Jul. 30, 2020.

International Search Report and Written Opinion for PCT/US2020/023730, dated Jul. 24, 2020.

International Search Report and Written Opinion for PCT/US2020/273713, dated Jun. 7, 2020.

International Search Report and Written Opinion for PCT/US2020/0273712, dated Jul. 7, 2020.

Invitation to Pay Additional Fees for PCT/US2020/023727, dated Jun. 30, 2020.

International Search Report and Written Opinion for PCT/US2020/023727, dated Aug. 12, 2020.

International Search Report and Written Opinion for PCT/US2020/023724, dated Jun. 29, 2020.

International Search Report and Written Opinion for PCT/US2020/023725, dated Jun. 29, 2020.

International Search Report and Written Opinion for PCT/US2020/023728, dated Jul. 9, 2020.

International Search Report and Written Opinion for PCT/US2020/023732, dated Jul. 3, 2020.

International Search Report and Written Opinion for PCT/US2020/023723, dated Jun. 26, 2020.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

(56) References Cited

OTHER PUBLICATIONS

Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jasin et al., Repair of strand breaks by homologous recombination. Cold Spring Harb Perspect Biol. Nov. 1, 2013;5(11):a012740. doi: 10.1101/cshperspect.a012740.
Jemielity et al., Novel "anti-reverse" cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johns et al., The promise and peril of continuous in vitro evolution. J Mol Evol. Aug. 2005;61(2):253-63. Epub Jun. 27, 2005.
Joho et al., Identification of a region of the bacteriophage T3 and T7 RNA polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al., TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.

Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012 ;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.

(56) References Cited

OTHER PUBLICATIONS

Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and micro satellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with No. detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Isolation of cloned Moloney murine leukemia virus reverse transcriptase lacking ribonuclease H activity. Nucleic Acids Res. Jan. 11, 1988; 16(1):265-77. doi: 10.1093/nar/16.1.265.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.

(56) References Cited

OTHER PUBLICATIONS

Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Krokan et al., Base excision repair. Cold Spring Harb Perspect Biol. Apr. 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Kwon et al., Chemical basis of glycine riboswitch cooperativity. RNA. Jan. 2008;14(1):25-34. Epub Nov. 27, 2007.
Lada et al., Mutator effects and mutation signatures of editing deaminases produced in bacteria and yeast. Biochemistry (Mosc). Jan. 2011;76(1):131-46.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes sitespecific phage integration vectors. J Bacteriol. Aug. 2002;184(15):4177-86. doi: 10.1128/jb.184.15.4177-4186.2002.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., ROSETTA3: an object-oriented software suite for the simulation and design of macromolecules. Methods Enzymol. 2011;487:545-74. doi: 10.1016/B978-0-12-381270-4.00019-6.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., An allosteric self-splicing ribozyme triggered by a bacterial second messenger. Science. Aug. 13, 2010;329(5993):845-8. doi: 10.1126/science.1190713.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lee et al., Site-specific integration of my cobacteriophage L5: integration-proficient vectors for *Mycobacterium smegmatis, Mycobacterium tuberculosis*, and bacille Calmette-Guèrin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Transcriptional regulation and its misregulation in disease. Cell. Mar. 14, 2013;152(6):1237-51. doi: 10.1016/j.cell.2013.02.014.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

(56) References Cited

OTHER PUBLICATIONS

Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.

Levy et al., Inhibition of calcification of bioprosthetic heart valves by local controlled-release diphosphonate. Science. Apr. 12, 1985;228(4696):190-2.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Building the Class 2 CRISPR-Cas Arsenal. Mol Cell 2017;65(3);377-379.

Lewis et al., Codon 129 polymorphism of the human prion protein influences the kinetics of amyloid formation. J Gen Virol. Aug. 2006;87(Pt 8):2443-9.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Current approaches for engineering proteins with diverse biological properties. Adv Exp Med Biol. 2007;620:18-33.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.

Li et al., Protein trans-splicing as a means for viral vector-mediated in vivo gene therapy. Hum Gene Ther. Sep. 2008;19(9):958-64. doi: 10.1089/hum.2008.009.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Liang et al., Correction of ?-thalassemia mutant by base editor in human embryos. Protein Cell. Nov. 2017;8(11):811-822. doi: 10.1007/s13238-017-0475-6. Epub Sep. 23, 2017.

Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.

Lieber et al., Mechanism and regulation of human non-homologous DNA end-joining. Nat Rev Mol Cell Biol. Sep. 2003;4(9):712-20.

Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.

Lilley, D.M. The Varkud Satellite Ribozyme. RNA. Feb. 2004;10(2):151-8.doi: 10.1261/ma.5217104.

Lim et al., Crystal structure of the moloney murine leukemia virus RNase H domain. J Virol. Sep. 2006;80(17):8379-89. doi: 10.1128/JVI.00750-06.

Lin et al., Enhanced homology-directed human genome engineering by controlled timing of CRISPR/Cas9 delivery. Elife. Dec. 15, 2014;3:e04766. doi: 10.7554/eLife.04766.

Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.

Liu et al., C2c1-sgRNA Complex Structure Reveals RNA-Guided DNA Cleavage Mechanism. Molecular Cell Jan. 2017;65(2):310-22.

Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.

Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Balancing AID and DNA repair during somatic hypermutation. Trends Immunol. Apr. 2009;30(4): 173-81. doi: 10.1016/j.it.2009.01.007.

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Design of polydactyl zinc-finger proteins for unique addressing within complex genomes. Proc Natl Acad Sci U S A. May 27, 1997;94(11):5525-30.

Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.

Liu et al., Distance determination by GIY-YIG intron endonucleases: discrimination between repression and cleavage functions. Nucleic Acids Res. Mar. 31, 2006;34(6):1755-64. Print 2006.

Liu et al., Editing DNA Methylation in the Mammalian Genome. Cell. Sep. 22, 2016;167(1):233-247.e17. doi: 10.1016/j.cell.2016.08.056.

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Liu et al., Fast Colorimetric Sensing of Adenosine and Cocaine Based on a General Sensor Design Involving Aptamers and Nanoparticles. Angew Chem. 2006;118(1):96-100.

Liu et al., Functional Nucleic Acid Sensors. Chem Rev. May 2009;109(5):1948-98. doi: 10.1021/cr030183i.

Liu et al., Highly efficient RNA-guided base editing in rabbit. Nat Commun. Jul. 13, 2018;9(1):2717. doi: 10.1038/s41467-018-05232-2.

Liu et al., N(6)-methyladenosine-dependent RNA structural switches regulate RNA-protein interactions. Nature. Feb. 26, 2015;518(7540):560-4. doi: 10.1038/nature14234.

(56) References Cited

OTHER PUBLICATIONS

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Losey et al., Crystal structure of *Staphylococcus sureus* tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lynch, Evolution of the mutation rate. Trends Genet. Aug. 2010;26(8):345-52. doi: 10.1016/j.tig.2010.05.003. Epub Jun. 30, 2010.

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.

Ma et al., Targeted AID-mediated mutagenesis (TAM) enables efficient genomic diversification in mammalian cells. Nature Methods. Oct. 2016;13:1029-35. doi:10.1038/nmeth.4027.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Classification and Nomenclature of CRISPR-Cas Systems: Where from Here? CRISPR J. Oct. 2018;1(5):325-336. doi: 10.1089/crispr.2018.0033.

Makarova et al., Evolution and classification of the CRISPR-Cas systems. Nat Rev Microbiol. Jun. 2011;9(6):467-77. doi: 10.1038/nrmicro2577. Epub May 9, 2011.

Makeyev et al., Evolutionary potential of an RNA virus. J Virol. Feb. 2004;78(4):2114-20.

Malashkevich et al., Crystal structure of tRNA adenosine deaminase TadA from *Escherichia coli*. Deposited: Mar. 10, 2005 Released: 2006-02-21 doi:10.2210/pdblz3a/pdb (2006).

Mali et al., Cas9 as a versatile tool for engineering biology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Marraffhini et al., CRISPR interference limits horizontal gene transfer in staphylococci by targeting DNA. Science. Dec. 19, 2008;322(5909):1843-5. doi: 10.1126/science.1165771.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mascola et al., HIV-1 neutralizing antibodies: understanding nature's pathways. Immunol Rev. Jul. 2013;254(1):225-44. doi: 10.1111/imr.12075.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

McInerney et al., Error Rate Comparison during Polymerase Chain Reaction by DNA Polymerase. Mol Biol Int. 2014;2014:287430. doi: 10.1155/2014/287430. Epub Aug. 17, 2014.

McKenna et al., Recording development with single cell dynamic lineage tracing. Development. Jun. 27, 2019;146(12):dev169730. doi: 10.1242/dev.169730.

(56) References Cited

OTHER PUBLICATIONS

McKenna et al., Whole-organism lineage tracing by combinatorial and cumulative genome editing. Science. Jul. 29, 2016;353(6298):aaf7907. doi: 10.1126/science.aaf7907. Epub May 26, 2016.

McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Mead et al., A novel protective prion protein variant that colocalizes with kuru exposure. N Engl J Med. Nov. 19, 2009;361(21):2056-65. doi: 10.1056/NEJMoa0809716.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Menèndez-Arias, Mutation rates and intrinsic fidelity of retroviral reverse transcriptases. Viruses. Dec. 2009;1(3):1137-65. doi: 10.3390/v1031137. Epub Dec. 4, 2009.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Mertens et al., Site-specific recombination in bacteriophage Mu: characterization of binding sites for the DNA invertase Gin. EMBO J. Apr. 1988;7(4):1219-27.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Meyer et al., Library generation by gene shuffling. Curr Protoc Mol Biol. Jan. 6, 2014;105:Unit 15.12.. doi: 10.1002/0471142727.mb1512s105.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitton-Fry et al., Poly(A) tail recognition by a viral RNA element through assembly of a triple helix. Science. Nov. 26, 2010;330(6008):1244-7. doi: 10.1126/science.1195858.

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018.

Mohr et al., Thermostable group II intron reverse transcriptase fusion proteins and their use in cDNA synthesis and next-generation RNA sequencing. RNA. Jul. 2013;19(7):958-70. doi: 10.1261/ma.039743.113. Epub May 22, 2013.

Mojica et al., Intervening sequences of regularly spaced prokaryotic repeats derive from foreign genetic elements. J Mol Evol. Feb. 2005;60(2):174-82.

Mol et al., Crystal structure of human uracil-DNA glycosylase in complex with a protein inhibitor: protein mimicry of DNA. Cell. Sep. 8, 1995;82(5):701-8.

Monahan et al., Site-specific incorporation of unnatural amino acids into receptors expressed in Mammalian cells. Chem Biol. Jun. 2003;10(6):573-80.

Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PloS One. 2012;7(5):e37877. Doi: 10.1371/journal.pone.0037877. Epub May 2, 20124.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5.

Morbitzer et al., Assembly of custom TALE-type DNA binding domains by modular cloning. Nucleic Acids Res. Jul. 2011;39(13):5790-9. doi: 10.1093/nar/gkrl51. Epub Mar. 1, 20118.

Morita et al., The site-specific recombination system of actinophage Tgi. Fems Microbiol Lett. Aug. 2009;297(2):234-40. doi: 10.1111/j.1574-6968.2009.01683.x.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 1, 20091;326(5959): 1501. doi: 10.1126/science. 1178817.

Muir et al., Expressed protein ligation: a general method for protein engineering. Proc Natl Acad Sci USA. Jun. 9, 1998;95(12):6705-10. doi: 10.1073/pnas.95.12.6705.

Muller et al., Nucleotide exchange and excision technology (NExT) DNA shuffling: a robust method for DNA fragmentation and directed evolution. Nucleic Acids Res. Aug. 2005 l;33(13):el 17. doi: 10.1093/nar/gnill6. PMID: 16061932; Pmcid: PMC1182171.

MULLINS et al., Transgenesis in nonmurine species. Hypertension. Oct. 1993;22(4):630-3.

(56) References Cited

OTHER PUBLICATIONS

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 1, 20127.

Muzyczka et al., Adeno-associated virus (AAV) vectors: will they work? J Clin Invest. Oct. 1994;94(4):1351. doi: 10.1172/JCI117468.

Myerowiiz et al., The major defect in Ashkenazi Jews with Tay-Sachs disease is an insertion in the gene for the alpha-chain of beta-hexosaminidase. J Biol Chem. Dec. 1, 19885;263(35):18587-9.

Nab El et al., Direct gene transfer for immunotherapy and immunization. Trends Biotechnol. May 1993;ll(5):211-5. doi: 10.1016/0167-7799(93)90117-R.

Nahvi et al., Coenzyme B12 riboswitches are widespread genetic control elements in prokaryotes. Nucleic Acids Res. Jan. 2, 2004;32(1): 143-50.

Nakade et al., Microhomology-mediated end-joining-dependent integration of donor DNA in cells and animals using TALENs and CRISPR/Cas9. Nat Commun. Nov. 2, 20140;5:5560. doi: 10.1038/ncomms6560.

Nakamura et al., Codon usage tabulated from international DNA sequence databases: status for the year 2000. Nucleic Acids Res. Jan. 1, 2000;28(1):292. doi: 10.1093/nar/28.1.292.

Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Nern et al., Multiple new site-specific recombinases for use in manipulating animal genomes. Proc Natl Acad Sci U S A. Aug. 23, 2011; 108(34):14198-203. doi: 10.1073/pnas.1111704108. Epub Aug. 9, 2011.

Nguyen et al., Evolutionary drivers of thermoadaptation in enzyme catalysis. Science. Jan. 20, 2017;355(6322):289-294. doi: 10.1126/science.aah3717. Epub Dec. 22, 2016.

Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.

Ni et al., A PCSK9-binding antibody that structurally mimics the EGF(A) domain of LDL-receptor reduces LDL cholesterol in vivo. J Lipid Res. 2011;52:76-86.

Ni et al., Nucleic acid aptamers: clinical applications and promising new horizons. Curr Med Chem. 2011;18(27):4206-14. Review.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishikura, Functions and regulation of RNA editing by ADAR deaminases. Annu Rev Biochem. 2010;79:321-349. doi:10.1146/annurev-biochem-060208-105251.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nishimasu et al., Crystal Structure of *Staphylococcus aureus* Cas9. Cell. Aug. 27, 2015;162(5):1113-26. doi: 10.1016/j.cell.2015.08.007.

Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.

Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Noris et al., A phenylalanine-55 to serine amino-acid substitution in the human glycoprotein IX leucine-rich repeat is associated with Bernard-Soulier syndrome. Br J Haematol. May 1997;97(2):312-20.

Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.

Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.

Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.

Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.

Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.

Oakes et al., Protein engineering of Cas9 for enhanced function. Methods Enzymol. 2014;546:491-511.

Odsbu et al., Specific N-terminal interactions of the *Escherichia coli* SeqA protein are required to form multimers that restrain negative supercoils and form foci. Genes Cells. Nov. 2005;10(11):1039-49.

Oeemig et al., Solution structure of DnaE intein from Nostoc punctiforme: structural basis for the design of a new split intein suitable for site-specific chemical modification. FEBS Lett. May 6, 2009;583(9):1451-6.

Offord, Advances in Genome Editing. The Scientist, Apr. 20, 2016. http://www.the-scientist.com/?articles.view/articleNo/45903/title/Advances-in-Genome-Editing/.

Oh et al., Positional cloning of a gene for Hermansky-Pudlak syndrome, a disorder of cytoplasmic organelles. Nat Genet. Nov. 1996;14(3):300-6. doi: 10.1038/ng1196-300.

Ohe et al., Purification and properties of xanthine dehydrogenase from Streptomyces cyanogenus. J Biochem. Jul. 1979;86(1):45-53.

Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.

Orthwein et al., A mechanism for the suppression of homologous recombination in G1 cells. Nature. Dec. 17, 2015;528(7582):422-6. doi: 10.1038/nature16142. Epub Dec. 9, 2015.

Osborn et al., TALEN-based gene correction for epidermolysis bullosa. Mol Ther. Jun. 2013;21(6):1151-9. doi: 10.1038/mt.2013.56. Epub Apr. 2, 2013.

Ostermeier et al., A combinatorial approach to hybrid enzymes independent of DNA homology. Nat Biotechnol. Dec. 1999;17(12):1205-9.

Otto et al., The probability of fixation in populations of changing size. Genetics. Jun. 1997;146(2):723-33.

(56) References Cited

OTHER PUBLICATIONS

Paige et al., RNA mimics of green fluorescent protein. Science. Jul. 29, 2011;333(6042):642-6. doi: 10.1126/science.1207339.

Pan et al., Biological and biomedical applications of engineered nucleases. Mol Biotechnol. Sep. 2013;55(1):54-62. doi: 10.1007/s12033-012-9613-9.

Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.

Park et al., Digenome-seq web tool for profiling CRISPR specificity. Nat Methods. May 30, 2017;14(6):548-549. doi: 10.1038/nmeth.4262.

Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.

Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pawson et al., Protein phosphorylation in signaling—50 years and counting. Trends Biochem Sci. Jun. 2005;30(6):286-90. doi: 10.1016/j.tibs.2005.04.013.

Pearl, Structure and function in the uracil-DNA glycosylase superfamily. Mutat Res. Aug. 30, 2000;460(3-4):165-81.

Peck et al., Directed evolution of a small-molecule-triggered intein with improved splicing properties in mammalian cells. Chem Biol. May 27, 2011;18(5):619-30. doi: 10.1016/j.chembiol.2011.02.014.

Pellenz et al., New human chromosomal safe harbor sites for genome engineering with CRISPR/Cas9, TAL effector and homing endonucleases. Aug. 20, 2018. bioRxiv doi: https://doi.org/10.1101/396390.

Pelletier, CRISPR-Cas systems for the study of the immune function. Nov. 15, 2016. https://doi.org/10.1002/9780470015902.a0026896.

Pennisi et al., The CRISPR craze. Science. Aug. 23, 2013;341(6148):833-6. doi: 10.1126/science.341.6148.833.

Pennisi et al., The tale of the TALEs. Science. Dec. 14, 2012;338(6113):1408-11. doi: 10.1126/science.338.6113.1408.

Perach et al., Catalytic features of the recombinant reverse transcriptase of bovine leukemia virus expressed in bacteria. Virology. Jun. 20, 1999;259(1):176-89. doi: 10.1006/viro.1999.9761.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Perler et al., Protein splicing elements: inteins and exteins—a definition of terms and recommended nomenclature. Nucleic Acids Res. Apr. 11, 1994;22(7):1125-7. doi: 10.1093/nar/22.7.1125.

Perler, InBase, the New England Biolabs Intein Database. Nucleic Acids Res. Jan. 1, 1999;27(1):346-7. doi: 10.1093/nar/27.1.346.

Perler, Protein splicing of inteins and hedgehog autoproteolysis: structure, function, and evolution. Cell. Jan. 9, 1998;92(1):1-4. doi: 10.1016/s0092-8674(00)80892-2.

Petek et al., Frequent endonuclease cleavage at off-target locations in vivo. Mol Ther. May 2010;18(5):983-6. Doi: 10.1038/mt.2010.35. Epub Mar. 9, 2010.

Petersen-Mahrt et al., AID mutates *E. coli* suggesting a DNA deamination mechanism for antibody diversification. Nature. Jul. 4, 2002;418(6893):99-103.

Petolino et al., Editing Plant Genomes: a new era of crop improvement. Plant Biotechnol J. Feb. 2016;14(2):435-6. doi: 10.1111/pbi.12542.

Peyroties et al., Oligodeoxynucleoside phosphoramidates (P-NH2): synthesis and thermal stability of duplexes with DNA and RNA targets. Nucleic Acids Res. May 15, 1996;24(10):1841-8.

Pfeiffer et al., Mechanisms of DNA double-strand break repair and their potential to induce chromosomal aberrations. Mutagenesis. Jul. 2000;15(4):289-302. doi: 10.1093/mutage/15.4.289.

Phillips, The challenge of gene therapy and DNA delivery. J Pharm Pharmacol. Sep. 2001;53(9):1169-74.

Pickart et al., Ubiquitin: structures, functions, mechanisms. Biochim Biophys Acta. Nov. 29, 2004;1695(1-3):55-72. doi: 10.1016/j.bbamcr.2004.09.019.

Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.

Pirakliikulr et al., PCRless library mutagenesis via oligonucleotide recombination in yeast. Protein Sci. Dec. 2010;19(12):2336-46. doi: 10.1002/pro.513.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Plosky et al., CRISPR-Mediated Base Editing without DNA Double-Strand Breaks. Mol Cell. May 19, 2016;62(4):477-8. doi: 10.1016/j.molcel.2016.05.006.

Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.

Poller et al., A leucine-to-proline substitution causes a defective alpha 1-antichymotrypsin allele associated with familial obstructive lung disease. Genomics. Sep. 1993;17(3):740-3.

Porteus, Design and testing of zinc finger nucleases for use in mammalian cells. Methods Mol Biol. 2008;435:47-61. doi: 10.1007/978-1-59745-232-8_4.

Posnick et al., Imbalanced base excision repair increases spontaneous mutation and alkylation sensitivity in *Escherichia coli*. J Bacteriol. Nov. 1999;181(21):6763-71.

Pospsílová et al., Hydrolytic cleavage of N6-substituted adenine derivatives by eukaryotic adenine and adenosine deaminases. Biosci Rep. 2008;28(6):335-347. doi:10.1042/BSR20080081.

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

(56) References Cited

OTHER PUBLICATIONS

Proudfoot et al., Zinc finger recombinases with adaptable DNA sequence specificity. PLoS One. Apr. 29, 2011;6(4):e19537. doi: 10.1371/journal.pone.0019537.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.

Rakonjac et al., Roles of PIII in filamentous phage assembly. J Mol Biol. 1998; 282(1)25-41.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. BMC Mol Biol. Mar. 22, 2014;15:6. doi: 10.1186/1471-2199-15-6.

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., A compendium of RNA-binding motifs for decoding gene regulation. Nature. Jul. 11, 2013;499(7457):172-7. doi: 10.1038/nature12311.

Ray et al., Homologous recombination: ends as the means. Trends Plant Sci. Oct. 2002;7(10):435-40.

Rebar et al., Phage display methods for selecting zinc finger proteins with novel DNA-binding specificities. Methods Enzymol. 1996;267:129-49.

Rebuzzini et al., New mammalian cellular systems to study mutations introduced at the break site by non-homologous end-joining. DNA Repair (Amst). May 2, 2005;4(5):546-55.

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-l.

Rees et al., Development of hRad51-Cas9 nickase fusions that mediate HDR without doublestranded breaks. Nat Commun. May 17, 2019;10(1):2212. doi: 10.1038/s41467-019-09983-4.

Rees et al., Improving the DNA specificity and applicability of base editing through protein engineering and protein delivery. Nat Commun. Jun. 6, 2017;8:15790. doi: 10.1038/ncomms15790.

Relph et al., Recent developments and current status of gene therapy using viral vectors in the United Kingdom. BMJ. 2004;329(7470):839-842. doi:10.1136/bmj.329.7470.839.

Ren et al., In-line Alignment and $Mg^{2+}$? Coordination at the Cleavage Site of the env22 Twister Ribozyme. Nat Commun. Nov. 20, 2014;5:5534. doi: 10.1038/ncomms6534.

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.

Reyon et al., FLASH assembly of TALENs for high-throughput genome editing. Nat Biotechnol. May 2012;30(5):460-5. doi: 10.1038/nbt.2170.

Ribeiro et al., Protein Engineering Strategies to Expand CRISPR-Cas9 Applications. Int J Genomics. Aug. 2, 2018;2018:1652567. doi: 10.1155/2018/1652567.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.

Riechmann et al.,. The C-terminal domain of TolA is the coreceptor for filamentous phage infection of *E. coli*. Cell. 1997; 90(2):351-60. PMID:9244308.

Ringrose et al., The Kw recombinase, an integrase from Kluyveromyces waltii. Eur J Biochem. Sep. 15, 1997;248(3):903-12. doi: 10.1111/j.1432-1033.1997.00903.x.

Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.

Roth et al., Purification and characterization of murine retroviral reverse transcriptase expressed in *Escherichia coli*. J Biol Chem. Aug. 5, 1985;260(16):9326-35.

(56) References Cited

OTHER PUBLICATIONS

Rouet et al., Expression of a site-specific endonuclease stimulates homologous recombination in mammalian cells. Proc Natl Acad Sci USA. Jun. 2, 19941;91(13):6064-8. doi: 10.1073/pnas.91.13.6064.

Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.

Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.

Roundtree et al.,YTHDC1 mediates nuclear export of N6-methyladenosine methylated mRNAs. Elife. Oct. 6, 2017;6:e31311. doi: 10.7554/eLife.31311.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.

Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.

Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.

Rüfer et al., Non-contact positions impose site selectivity on Cre recombinase. Nucleic Acids Res. Jul. 1, 2002;30(13):2764-71. doi: 10.1093/nar/gkf399.

Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.

Sadelain et al., Safe harbours for the integration of new DNA in the human genome. Nat Rev Cancer. Dec. 1, 2011;12(1):51-8. doi: 10.1038/nrc3179.

Sage et al., Proliferation of functional hair cells in vivo in the absence of the retinoblastoma protein. Science. Feb. 18, 2005;307(5712):1114-8. Epub Jan. 13, 2005.

Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.

Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.

Samal et al., Cationic polymers and their therapeutic potential. Chem Soc Rev. Nov. 7, 2012;41(21):7147-94. doi: 10.1039/c2cs35094g. Epub Aug. 10, 2012.

Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Sang, Prospects for transgenesis in the chick. Meeh Dev. Sep. 2004;121(9):1179-86.

Sanjana et al., A transcription activator-like effector toolbox for genome engineering. Nat Protoc. Jan. 5, 2012;7(1):171-92. doi: 10.1038/nprot.2011.431.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Santoro et al., Directed evolution of the site specificity of Cre recombinase. Proc Natl Acad Sci U S A. Apr. 2, 2002;99(7):4185-90. Epub Mar. 19, 2002.

Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

Sasidharan et al., The selection of acceptable protein mutations. PNAS; Jun. 12, 2007;104(24):10080-5. www.pnas.org/cgi/doi/10.1073.pnas.0703737104.

Satomura et al., Precise genome-wide base editing by the CRISPR Nickase system in yeast. Sci Rep. May 18, 2017;7(1):2095. doi: 10.1038/s41598-017-02013-7.

Saudek et al., A preliminary trial of the programmable implantable medication system for insulin delivery. N Engl J Med. Aug. 31, 1989;321(9):574-9.

Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.

Schaaper et al., Base selection, proofreading, and mismatch repair during DNA replication in *Escherichia coli*. J Biol Chem. Nov. 15, 1993;268(32):23762-5.

Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

Schaefer et al., Understanding RNA modifications: the promises and technological bottlenecks of the 'epitranscriptome'. Open Biol. May 2017;7(5):170077. doi: 10.1098/rsob.170077.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001;108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schöller et al., Interactions, localization, and phosphorylation of the m6A generating METTL3-METTL14-WTAP complex. RNA. Apr. 2018;24(4):499-512. doi: 10.1261/ma.064063.117. Epub Jan. 18, 2018.

Schrtefer et al., Low pressure DNA shearing: a method for random DNA sequence analysis. Nucleic Acids Res. Dec. 25, 1990;18(24):7455-6.

Schultz et al., Oligo-2+-fluoro-2+-deoxynucleotide N3'—>P5' phosphoramidates: synthesis and properties. Nucleic Acids Res. Aug. 1, 1996;24(15):2966-73.

(56) References Cited

OTHER PUBLICATIONS

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Scott et al., Production of cyclic peptides and proteins in vivo. Proc Natl Acad Sci U S A. Nov. 23, 1999;96(24):13638-43. doi: 10.1073/pnas.96.24.13638.
Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3∝ DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine-and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Severinov et al., Expressed protein ligation, a novel method for studying protein-protein interactions in transcription. J Biol Chem. Jun. 26, 1998;273(26):16205-9. doi: 10.1074/jbc.273.26.16205.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shalem et al., High-throughput functional genomics using CRISPR-Cas9. Nat Rev Genet. May 2015;16(5):299-311. doi: 10.1038/nrg3899. Epub Apr. 9, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Shen et al., Predictable and precise template-free CRISPR editing of pathogenic variants. Nature. Nov. 2018;563(7733):646-651. doi: 10.1038/s41586-018-0686-x. Epub Nov. 7, 2018. Erratum in: Nature. Mar. 2019;567(7746):E1-E2.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.

(56) References Cited

OTHER PUBLICATIONS

Simonelli et al., Base excision repair intermediates are mutagenic in mammalian cells. Nucleic Acids Res. Aug. 2, 2005;33(14):4404-11. Print 2005.

Singh et al., Cross-talk between diverse serine integrases. J Mol Biol. Jan. 23, 2014;426(2):318-31. doi: 10.1016/j.jmb.2013.10.013. Epub Oct. 22, 2013.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

Sjoblom et al., The consensus coding sequences of human breast and colorectal cancers. Science. Oct. 13, 2006;314(5797):268-74. Epub Sep. 7, 2006.

Skretas et al., Regulation of protein activity with small-molecule-controlled inteins. Protein Sci. Feb. 2005;14(2):523-32. Epub Jan. 4, 2005.

Slaymaker et al., Rationally engineered Cas9 nucleases with improved specificity. Science. Jan. 1, 2016;351(6268):84-8. doi: 10.1126/science.aad5227. Epub Dec. 1, 2015.

Sledz et al., Structural insights into the molecular mechanism of the m(6)A writer complex. Elife. Sep. 14, 2016;5:e18434. doi: 10.7554/eLife.18434.

Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Smith et al., Production of human beta interferon in insect cells infected with a baculovirus expression vector. Mol Cell Biol. Dec. 1983;3(12):2156-65. doi: 10.1128/mcb.3.12.2156.

Smith, Filamentous fusion phage: novel expression vectors that display cloned antigens on the virion surface. Science. Jun. 14, 1985;228(4705):1315-7.

Smith, Phage-encoded Serine Integrases and Other Large Serine Recombinases. Microbiol Spectr. Aug. 2015;3(4). doi: 10.1128/microbiolspec.MDNA3-0059-2014.

Southworth et al., Control of protein splicing by intein fragment reassembly. EMBO J. Feb. 16, 1998;17(4):918-26. doi: 10.1093/emboj/17.4.918.

Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.

Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.

Spencer et al., Functional analysis of Fas signaling in vivo using synthetic inducers of dimerization. Curr Biol. Jul. 1, 1996;6(7):839-47. doi: 10.1016/s0960-9822(02)00607-3.

Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.

Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.

Steele et al., The prion protein knockout mouse: a phenotype under challenge. Prion. Apr.-Jun. 2007;1(2):83-93. doi: 10.4161/pri.1.2.4346. Epub Apr. 25, 2007.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stephens et al., The landscape of cancer genes and mutational processes in breast cancer. Nature Jun. 2012;486:400-404. doi: 10.1038/nature11017.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sterne-Weiler et al., Exon identity crisis: disease-causing mutations that disrupt the splicing code. Genome Biol. Jan. 23, 2014;15(1):201. doi: 10.1186/gb4150.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

Stockwell et al., Probing the role of homomeric and heteromeric receptor interactions in TGF-beta signaling using small molecule dimerizers. Curr Biol. Jun. 18, 1998;8( 13):761-70. doi: 10.1016/s0960-9822(98)70299-4.

Strecker et al., RNA-guided DNA insertion with CRISPR-associated transposases. Science. Jul. 5, 2019;365(6448):48-53. doi: 10.1126/science.aax9181. Epub Jun. 6, 2019.

Strutt et al., RNA-dependent RNA targeting by CRISPR-Cas9. Elife. Jan. 5, 2018;7:e32724. doi: 10.7554/eLife.32724.

Su et al., Human DNA polymerase ? has reverse transcriptase activity in cellular environments. J Biol Chem. Apr. 12, 2019;294(15):6073-6081. doi: 10.1074/jbc.RA1119.007925. Epub Mar. 6, 2019.

Sudarsan et al., An mRNA structure in bacteria that controls gene expression by binding lysine. Genes Dev. Nov. 1, 2003;17(21):2688-97.

Sudarsan et al., Riboswitches in eubacteria sense the second messenger cyclic di-GMP. Science. Jul. 18, 2008;321(5887):411-3. doi: 10.1126/science.1159519.

Suess et al., A theophylline responsive riboswitch based on helix slipping controls gene expression in vivo. Nucleic Acids Res. Mar. 5, 2004;32(4):1610-4.

Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

Sun et al., The CRISPR/Cas9 system for gene editing and its potential application in pain research. Transl Periop & Pain Med. Aug. 3, 2016;1(3):22-33.

Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.

Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.

Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.

Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.

Swarts et al., DNA-guided DNA interference by a prokaryotic Argonaute. Nature. Mar. 13, 2014;507(7491):258-61. doi: 10.1038/nature12971. Epub Feb. 16, 2014.

Swarts et al., The evolutionary journey of Argonaute proteins. Nat Struct Mol Biol. Sep. 2014;21(9):743-53. doi: 10.1038/nsmb.2879.

Szczepek et al., Structure-based redesign of the dimerization interface reduces the toxicity of zinc-finger nucleases. Nat Biotechnol. Jul. 2007;25(7):786-93. Epub Jul. 1, 2007.

Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.

Tagalakis et al., Lack of RNA-DNA oligonucleotide (chimeraplast) mutagenic activity in mouse embryos. Mol Reprod Dev. Jun. 2005;71(2):140-4.

(56) References Cited

OTHER PUBLICATIONS

Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Toor et al., Crystal structure of a self-spliced group II intron. Science. Apr. 4, 2008;320(5872):77-82. doi: 10.1126/science.1153803.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.

(56) References Cited

OTHER PUBLICATIONS

Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
Uniprot Consortium, UniProt: the universal protein knowledgebase. Nucleic Acids Res. Mar. 16, 2018;46(5):2699. doi: 10.1093/nar/gky092.
Uniprot Submission; UniProt, Accession No. P01011. Last modified Jun. 11, 2014, version 2. 15 pages.
Uniprot Submission; UniProt, Accession No. P01011. Last modified Sep. 18, 2013, version 2. 15 pages.
Uniprot Submission; UniProt, Accession No. P04264. Last modified Jun. 11, 2014, version 6. 15 pages.
Uniprot Submission; UniProt, Accession No. P04275. Last modified Jul. 9, 2014, version 107. 29 pages.
UniprotKB Submission; Accession No. F0NH53. May 3, 2011. 4 pages.
UniprotKB Submission; Accession No. F0NN87. May 3, 2011. 4 pages.
UniprotKB Submission; Accession No. G3ECR1.2. No Author Listed., Aug. 12, 2020, 8 pages.
UniprotKB Submission; Accession No. P04264. No Author Listed., Apr. 7, 2021. 12 pages.
UniprotKB Submission; Accession No. T0D7A2. Oct. 16, 2013. 10 pages.
UniprotKB Submission; Accession No. U2UMQ6. No Author Listed., Apr. 7, 2021, 11 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Brunt et al., Molecular Farming: Transgenic Animals as Bioreactors. Biotechnology (NY). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vik et al., Endonuclease V cleaves at inosines in RNA. Nat Commun. 2013;4:2271. doi: 10.1038/ncomms3271.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vase Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.

(56) References Cited

OTHER PUBLICATIONS

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Weber et al., Assembly of designer TAL effectors by Golden Gate cloning. PLoS One. 2011;6(5):e19722. doi:10.1371/journal.pone.0019722. Epub May 19, 2011.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human C1C-1 chloride channels in myotonia congenita. J Physiol. Aug. 1, 2012;590(Pt 15):3449-64. doi: 0.1113/jphysiol.2012.232785. Epub May 28, 2012.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alphahelix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., Targeted genome editing across species using ZFNs and TALENs. Science. Jul. 15, 2011;333(6040):307. doi: 10.1126/science.1207773. Epub Jun. 23, 2011.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xiong et al., Origin and evolution of retroelements based upon their reverse transcriptase sequences. EMBO J. Oct. 1990;9(10):3353-62.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Protein splicing: an analysis of the branched intermediate and its resolution by succinimide formation. EMBO J. Dec. 1, 1994;13(23):5517-22.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final

(56) References Cited

OTHER PUBLICATIONS

Coupling Reaction. Angew Chem Int Ed Engl. Aug. 28, 2017;56(36):10796-10800. doi: 10.1002/anie.201705523. Epub Jul. 28, 2017.

Yamamoto et al., The ons and offs of inducible transgenic technology: a review. Neurobiol Dis. Dec. 2001;8(6):923-32.

Yamamoto et al., Virological and immunological bases for HIV-1 vaccine design. Uirusu 2007;57(2):133-139. https://doi.org/10.2222/jsv.57.133.

Yamano et al., Crystal Structure of Cpf1 in Complex with Guide RNA and Target DNA. Cell May 2016;165(4)949-62.

Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yang et al., APOBEC: From mutator to editor. J Genet Genomics. Sep. 20, 2017;44(9):423-437. doi: 10.1016/j.jgg.2017.04.009. Epub Aug. 7, 2017.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., New CRISPR-Cas systems discovered. Cell Res. Mar. 2017;27(3):313-314. doi: 10.1038/cr.2017.21. Epub Feb. 21, 2017.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., PAM-dependent Target DNA Recognition and Cleavage by C2C1 CRISPR-Cas endonuclease. Cell Dec. 2016;167(7):1814-28.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang, PAML 4: phylogenetic analysis by maximum likelihood. Mol Biol Evol. Aug. 2007;24(8):1586-91. doi: 10.1093/molbev/msm088. Epub May 4, 2007.

Yang, Phylogenetic Analysis by Maximum Likelihood (PAML).// abacus.gene.ucl.ac.uk/software/paml.html Last accessed Apr. 28, 2021.

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yazaki et al., Hereditary systemic amyloidosis associated with a new apolipoprotein AII stop codon mutation Stop78Arg. Kidney Int. Jul. 2003;64(1):11-6.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.

Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Liposome-mediated in vivo E1A gene transfer suppressed dissemination of ovarian cancer cells that overexpress HER-2/neu. Oncogene. Oct. 5, 1995;11(7):1383-8.

Yu et al., Small molecules enhance CRISPR genome editing in pluripotent stem cells. Cell Stem Cell. Feb. 5, 2015;16(2):142-7. doi: 10.1016/j.stem.2015.01.003.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Yuan et al., Laboratory-directed protein evolution. Microbiol Mol Biol Rev. 2005; 69(3):373-92. PMID: 16148303.

Yuan et al., Tetrameric structure of a serine integrase catalytic domain. Structure. Aug. 6, 2008;16(8):1275-86. doi: 10.1016/j.str.2008.04.018.

Yuen et al., Control of transcription factor activity and osteoblast differentiation in mammalian cells using an evolved small-molecule-dependent intein. J Am Chem Soc. Jul. 12, 2006;128(27):8939-46.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

Zelphati et al., Intracellular delivery of proteins with a new lipid-mediated delivery system. J Biol Chem. Sep. 14, 2001;276(37):35103-10. Epub Jul. 10, 2001.

Zetsche et al., A split-Cas9 architecture for inducible genome editing and transcription modulation. Nat Biotechnol. Feb. 2015;33(2):139-42. doi: 10.1038/nbt.3149.

Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., Circular intronic long noncoding RNAs. Mol Cell. Sep. 26, 2013;51(6):792-806. doi: 10.1016/j.molcel.2013.08.017. Epub Sep. 12, 2013.

Zhang et al., Comparison of non-canonical PAMs for CRISPR/Cas9-mediated DNA cleavage in human cells. Sci Rep. Jun. 2014;4:5405.

Zhang et al., Conditional gene manipulation: Cre-ating a new biological era. J Zhejiang Univ Sci B. Jul. 2012; 13(7):511-24. doi: 10.1631/jzus.B1200042. Review.

Zhang et al., Copy number variation in human health, disease, and evolution. Annu Rev Genomics Hum Genet. 2009;10:451-81. doi: 10.1146/annurev.genom.9.081307.164217.

Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zhang et al., Programmable base editing of zebrafish genome using a modified CRISPR-Cas9 system. Nat Commun. Jul. 25, 2017;8(1):118. doi: 10.1038/s41467-017-00175-6.

Zhang et al., Ribozymes and Riboswitches: Modulation of RNA Function by Small Molecules. Biochemistry. Nov. 2, 2010;49(43):9123-31. doi: 10.1021/bi1012645.

Zhang et al., Stabilized plasmid-lipid particles for regional gene therapy: formulation and transfection properties. Gene Ther. Aug. 1999;6(8):1438-47.

Zhang et al., Π-Clamp-mediated cysteine conjugation. Nat Chem. Feb. 2016;8(2):120-8. doi: 10.1038/nchem.2413. Epub Dec. 21, 2015.

(56) References Cited

OTHER PUBLICATIONS

Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., DNA editing in DNA/RNA hybrids by adenosine deaminases that act on RNA. Nucleic Acids Res. Apr. 7, 2012;45(6):3369-3377. doi: 10.1093/nar/gkx050.

Zheng et al., Highly efficient base editing in bacteria using a Cas9-cytidine deaminase fusion. Commun Biol. Apr. 19, 2018;1:32. doi: 10.1038/s42003-018-0035-5.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zimmermann et al., Molecular interactions and metal binding in the theophylline-binding core of an RNA aptamer. RNA. May 2000;6(5):659-67.

Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.

Zorko et al., Cell-penetrating peptides: mechanism and kinetics of cargo delivery. Adv Drug Deliv Rev. Feb. 28, 2005;57(4):529-45. Epub Jan. 22, 2005.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Zuris et al., Cationic lipid-mediated delivery of proteins enables efficient protein-based genome editing in vitro and in vivo. Nat Biotechnol. 2015;33:73-80.

[No Author Listed] "Chronic Wasting Disease (CWD): Occurence" CDC Centers for Disease Control and Prevention. Last accessed online Apr. 28, 2021 via https://www.cdc.gov/prions/cwd/occurrence.html.

[No Author Listed] NCBI Accession No. XP_021505673.1. C ->U editing enzyme APOBEC-1 [Meriones unguiculatus], XP002793541. Jun. 27, 2017.

[No Author Listed] NCBI Reference Sequence: WP_00087959824.1. Oct. 9, 2019. 2 pages.

[No Author Listed] NCBI Reference Sequence: WP_001516895.1. Mar. 13, 2021. 2 pages.

[No Author Listed] Nucleic Acid Data from New England Biolabs. Printed Sep. 28, 2021. 1 page.

[No Author Listed] Transcription activator-like effector nuclease. Wikipedia. Last edited Sep. 27, 2021. Accessed via https://en.wikipedia.org/w/index.php?title=Transcription_activatorlike_effector_nuclease&oldid=1046813325 on Sep. 28, 2021. 9 pages.

Akopian et al., Chimeric recombinases with designed DNA sequence recognition. Proc Natl Acad Sci U S A. Jul. 22, 2003;100(15):8688-91. Epub Jul. 1, 2003.

André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.

Anonymous Third Party Observations for PCT/US2020/023712, dated Jul. 17, 2021.

Benarroch, HCN channels: function and clinical implications. Neurology. Jan. 15, 2013;80(3):304-10. doi: 10.1212/WNL.0b013e31827dec42.

Berges et al., Transduction of brain by herpes simplex virus vectors. Mol Ther. Jan. 2007;15(1):20-9. doi: 10.1038/sj.mt.6300018.

Bhagwat, DNA-cytosine deaminases: from antibody maturation to antiviral defense. DNA Repair (Amst). Jan. 5, 2004;3(1):85-9.

Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.

Burke et al., Activating mutations of Tn3 resolvase marking interfaces important in recombination catalysis and its regulation. Mol Microbiol. Feb. 2004;51(4):937-48.

Burton et al., Gene delivery using herpes simplex virus vectors. DNA Cell Biol. Dec. 2002;21(12):915-36. doi: 10.1089/104454902762053864.

Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.

Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.

Chavez et al., Therapeutic applications of the ?C31 integrase system. Curr Gene Ther. Oct. 2011;11(5):375-81. Review.

Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Cho et al., The calcium-activated chloride channel anoctamin 1 acts as a heat sensor in nociceptive neurons. Nat Neurosci. May 27, 2012;15(7):1015-21. doi: 10.1038/nn.3111.

Choi et at al., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.

Cox et al., An SCN9A channelopathy causes congenital inability to experience pain. Nature. Dec. 14, 2006;444(7121):894-8. doi: 10.1038/nature05413.

Cox et al., Congenital insensitivity to pain: novel SCN9A missense and in-frame deletion mutations. Hum Mutat. Sep. 2010;31(9):E1670-86. doi: 10.1002/humu.21325.

Cronican et al., A class of human proteins that deliver functional proteins into mammalian cells in vitro and in vivo. Chem Biol. Jul. 29, 2011;18(7):833-8. doi: 10.1016/j.chembiol.2011.07.003.

(56) References Cited

OTHER PUBLICATIONS

Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Database EBI Accession No. ADE34233 Jan. 29, 2004.
Database EBI Accession No. BFF09785. May 3, 20181. 2 pages.
Database EBI Accession No. BGE38086. Jul. 25, 2019. 2 pages.
Database UniProt Accession No. G8I3E0. Jan. 14, 2012.
Davidson et al., Viral vectors for gene delivery to the nervous system. Nat Rev Neurosci. May 2003;4(5):353-64. doi: 10.1038/nrn1104.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Emery et al., HCN2 ion channels play a central role in inflammatory and neuropathic pain. Science. Sep. 9, 2011;333(6048):1462-6. doi: 10.1126/science.1206243.
Epstein, HSV-1-based amplicon vectors: design and applications. Gene Ther. Oct. 2005;12 Suppl 1:S154-8. doi: 10.1038/sj.gt.3302617.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.
Forttni et al., Different DNA polymerases are involved in the short- and long-patch base excision repair in mammalian cells. Biochemistry. Mar. 17, 1998;37(11):3575-80. doi: 10.1021/bi972999h.
Fusi et al., In Silico Predictive Modeling of CRISPR/Cas9 guide efficiency. Jun. 26, 2015; bioRxiv. http://dx.doi.org/10.1101/021568.
Gapinske et al., CRISPR-SKIP: programmable gene splicing with single base editors. Genome Biol. Aug. 15, 2018;19(1):107. doi: 10.1186/s13059-018-1482-5.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Genbank Submission; NIH/NCBI, Accession No. BDB43378. Zhang et al., Aug. 11, 2016. 2 pages.
Genbank Submission; NIH/NCBI, Accession No. NM_002945.3. Weiser et al., Sep. 3, 2017. 5 pages.
Genbank Submission; NIH/NCBI, Accession No. NM_002946.5. Kavli et al., Jun. 26, 2021. 5 pages.
Genbank Submission; NIH/NCBI, Accession No. NM_002947.4. Xiao et al., May 1, 2019. 4 pages.
Genbank Submission; NIH/NCBI, Accession No. NM_003686.4. Umar et al., Apr. 9, 2021. 7 pages.
Genbank Submission; NIH/NCBI, Accession No. NP_001243439.1. Lee et al., Jul. 26, 2021. 4 pages.
Genbank Submission; NIH/NCBI, Accession No. NP_076161.2. Wade et al., Jun. 20, 2021. 4 pages.
Genbank Submission; NIH/NCBI, Accession No. NP_358988.1. Hoskins et al., Jan. 11, 2017. 2 pages.
Genbank Submission; NIH/NCBI, Accession No. NP_391970.1. Borriss et al., Feb. 12, 2021. 3 pages.
Genbank Submission; NIH/NCBI, Accession No. NP_628093.1. Hsiao et al., Aug. 3, 2016. 2 pages.
Genbank Submission; NIH/NCBI, Accession No. YP_002004532.1. Villegas et al., Oct. 11, 2021. 2 pages.
Genbank Submission; NIH/NCBI, Accession No. YP_006589943.1. Lynch et al., Oct. 15, 2021. 2 pages.
Genbank Submission; NIH/NCBI, Accession No. YP_009137104.1. Davison, Aug. 13, 2018. 2 pages.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Goldberg et al., Loss-of-function mutations in the Navi.7 gene underlie congenital indifference to pain in multiple human populations. Clin Genet. Apr. 2007;71(4):311-9. doi: 10.1111/j.1399-0004.2007.00790.X.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grindley et al., Mechanisms of site-specific recombination. Annu Rev Biochem. 2006;75:567-605. doi: 10.1146/annurev.biochem.73.011303.073908.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Phage integrases: biology and applications. J Mol Biol. Jan. 16, 2004;335(3):667-78.
Guo et al., Structure of Cre recombinase complexed with DNA in a site-specific recombination synapse. Nature. Sep. 4, 1997;389(6646):40-6.
Hartung et al., Cre mutants with altered DNA binding properties. J Biol Chem. Sep. 4, 1998;273(36):22884-91.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hotta et al., [Neurotropic viruses—classification, structure and characteristics]. Nihon Rinsho. Apr. 1997;55(4):777-82. Japanese.
Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.
International Preliminary Report on Patentability for PCT/US2020/023712, dated Sep. 30, 2021.

(56) References Cited

OTHER PUBLICATIONS

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet. 2012.08.013. Epub Aug. 23, 2012.

Jiricny, The multifaceted mismatch-repair system. Nat Rev Mol Cell Biol. May 2006;7(5):335-46. doi: 10.1038/nrm1907.

Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.

Kavli et al., Excision of cytosine and thymine from DNA by mutants of human uracil-DNA glycosylase. EMBO J. Jul. 1, 1996;15(13):3442-7.

Kay et al., Viral vectors for gene therapy: the art of turning infectious agents into vehicles of therapeutics. Nat Med. Jan. 2001;7(1):33-40.

Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.

Kilbride et al., Determinants of product topology in a hybrid Cre-Tn3 resolvase site-specific recombination system. J Mol Biol. Jan. 13, 2006;355(2):185-95. Epub Nov. 9, 2005.

Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.

Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.

Koblan et al., Efficient C•G-to-G•C base editors developed using CRISPRi screens, target-library analysis, and machine learning. Nature Biotechnol. Jun. 28, 2021. https://doi.org/10.1038/s41587-021-00938-z.

Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.

Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Li, Mechanisms and functions of DNA mismatch repair. Cell Res. Jan. 2008;18(1):85-98. doi: 10.1038/cr.2007.115.

Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.

Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.

Lin et al., The human REV1 gene codes for a DNA template-dependent dCMP transferase. Nucleic Acids Res. Nov. 15, 1999;27(22):4468-75. doi: 10.1093/nar/27.22.4468.

Liu et al., Computational approaches for effective CRISPR guide RNA design and evaluation. Comput Struct Biotechnol J. Nov. 29, 2019;18:35-44. doi: 10.1016/j.csbj.2019.11.006.

Lyons et al., Efficient Recognition of an Unpaired Lesion by a DNA Repair Glycosylase. J. Am. Chem. Soc., 2009;131(49):17742-3. DOI: 10.1021/ja908378y.

Maizels et al., Initiation of homologous recombination at DNA nicks. Nucleic Acids Res. Aug. 21, 2018;46(14):6962-6973. doi: 10.1093/nar/gky588.

Marzec et al., Prime Editing: A New Way for Genome Editing. Trends Cell Biol. Apr. 2020;30(4):257-259. doi: 10.1016/j.tcb.2020.01.004. Epub Jan. 27, 2020.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas. 0807883106. Epub Mar. 23, 2009.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714. e8. doi: 10.1016/j.molcel.2018.09.013. Epub Oct. 18, 2018. Including Supplemental Information.

Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.

Mougiakos et al., Characterizing a thermostable Cas9 for bacterial genome editing and silencing. Nat Commun. Nov. 21, 2017;8(1):1647. doi: 10.1038/s41467-017-01591-4.

Murphy, Phage recombinases and their applications. Adv Virus Res. 2012;83:367-414. doi: 10.1016/B978-0-12-394438-2.00008-6. Review.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

O'Maille et al., Structure-based combinatorial protein engineering (SCOPE). J Mol Biol. Aug. 23, 2002;321(4):677-91.

Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.

Pham et al., Reward versus risk: DNA cytidine deaminases triggering immunity and disease. Biochemistry. Mar. 1, 2005;44(8):2703-15.

Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.

Reynaud et al., What role for AID: mutator, or assembler of the immunoglobulin mutasome? Nat Immunol. Jul. 2003;4(7):631-8.

Robertson et al.,DNA repair in mammalian cells: Base excision repair: the long and short of it. Cell Mol Life Sci. Mar. 2009;66(6):981-93. doi: 10.1007/s00018-009-8736-z.

Rongrong et al., Effect of deletion mutation on the recombination activity of Cre recombinase. Acta Biochim Pol. 2005;52(2):541-4. Epub May 15, 2005.

Sale et al., Y-family DNA polymerases and their role in tolerance of cellular DNA damage. Nat Rev Mol Cell Biol. Feb. 23, 2012;13(3):141-52. doi: 10.1038/nrm3289.

Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.

Sapunar et al., Dorsal root ganglion—a potential new therapeutic target for neuropathic pain. J Pain Res. 2012;5:31-8. doi: 10.2147/JPR.S26603. Epub Feb. 16, 2012.

Savva et al., The structural basis of specific base-excision repair by uracil-DNA glycosylase. Nature. Feb. 9, 1995;373(6514):487-93. doi: 10.1038/373487a0.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.

(56) References Cited

OTHER PUBLICATIONS

Shaikh et al., Chimeras of the Flp and Cre recombinases: tests of the mode of cleavage by Flp and Cre. J Mol Biol. Sep. 8, 2000;302(1):27-48.

Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.

Shen et al., Predictable and precise template-free CRISPR editing of pathogenic variants. Nature. Nov. 2018;563(7733):646-651. doi: 10.1038/s41586-018-0686-x. Epub Nov. 7, 2018.

Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.

Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.

Slupphaug et al., A nucleotide-flipping mechanism from the structure of human uracil-DNA glycosylase bound to DNA. Nature. Nov. 7, 1996;384(6604):87-92. doi: 10.1038/384087a0.

Smith et al., Diversity in the serine recombinases. Mol Microbiol. Apr. 2002;44(2):299-307. Review.

Smith et al., Herpesvirus transport to the nervous system and back again. Annu Rev Microbiol. 2012;66:153-76. doi: 10.1146/annurev-micro-092611-150051. Epub Jun. 15, 2012.

Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.

Steiner et al., The neurotropic herpes viruses: herpes simplex and varicella-zoster. Lancet Neurol. Nov. 2007;6(11):1015-28. doi: 10.1016/S1474-4422(07)70267-3.

Strecker et al., Engineering of CRISPR-Cas12b for human genome editing. Nat Commun. Jan. 22, 2019;10(1):212. doi: 10.1038/s41467-018-08224-4.

Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.

UniprotKB Submission; Accession No. P0DOC6. No Author Listed., Oct. 5, 2016. 5 pages.

Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.

Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.

Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.

Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.

Weill et al., DNA polymerases in adaptive immunity. Nat Rev Immunol. Apr. 2008;8(4):302-12. doi: 10.1038/nri2281. Epub Mar. 14, 2008.

Weiss et al., Loss-of-function mutations in sodium channel Navi.7 cause anosmia. Nature. Apr. 14, 2011;472(7342):186-90. doi: 10.1038/nature09975. Epub Mar. 23, 2011.

Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.

Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.

Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.

Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121./doi.org/10.1016/j.molcel.2017.02.007.

Yamano et al., Crystal Structure of Cpf1 in Complex with Guide RNA and Target DNA. Cell. May 5, 2016;165(4):949-62 and Supplemental Info, doi: 10.1016/j.cell.2016.04.003. Epub Apr. 21, 2016.

Yan et al., Functionally diverse type V CRISPR-Cas systems. Science. Jan. 4, 2019;363(6422):88-91. doi: 10.1126/science.aav7271. Epub Dec. 6, 2018.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., One Prime for All Editing. Cell. Dec. 12, 2019;179(7):1448-1450. doi: 10.1016/j.cell.2019.11.030.

Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yasui, Alternative excision repair pathways. Cold Spring Harb Perspect Biol. Jun. 1, 2013;5(6):a012617. doi: 10.1101/cshperspect.a012617.

Zetsche et al., Cpf1 is a single RNA-guided endonuclease of a class 2 CRISPR-Cas system. Cell. Oct. 22, 2015;163(3):759-71 and Supplemental Info, doi: 10.1016/j.cell.2015.09.038. Epub Sep. 25, 2015.

U.S. Appl. No. 17/425,261, filed Jul. 22, 2021, Kim et al.
U.S. Appl. No. 17/294,287, filed May 14, 2021, Liu et al.
U.S. Appl. No. 17/436,048, filed Sep. 2, 2021, Liu et al.
U.S. Appl. No. 17/603,917, filed Oct. 14, 2021, Liu et al.
U.S. Appl. No. 17/602,738, filed Oct. 8, 2021, Liu et al.
U.S. Appl. No. 17/613,025, filed Nov. 19, 2021, Liu et al.
U.S. Appl. No. 17/300,668, filed Sep. 17, 2021, Liu et al.
U.S. Appl. No. 17/440,682, filed Sep. 17, 2021, Liu et al.
U.S. Appl. No. 15/029,602, filed Apr. 14, 2016, Ritter et al.
U.S. Appl. No. 17/408,306, filed Aug. 20, 2021, Liu et al.
U.S. Appl. No. 15/748,053, filed Jan. 26, 2018, Liu et al.
U.S. Appl. No. 16/804,228, filed Feb. 28, 2020, Liu et al.
U.S. Appl. No. 17/355,735, filed Jun. 23, 2021, Liu et al.
U.S. Appl. No. 15/331,852, filed Oct. 22, 2016, Liu et al.
U.S. Appl. No. 17/527,011, filed Nov. 15, 2021, Liu et al.
U.S. Appl. No. 17/593,020, filed Sep. 3, 2021, Church et al.
PCT/US2020/023712, dated Jul. 17, 2021, Anonymous Third Party Observations.
PCT/US2020/023712, dated Sep. 30, 202, International Preliminary Reort on Patentability.

* cited by examiner

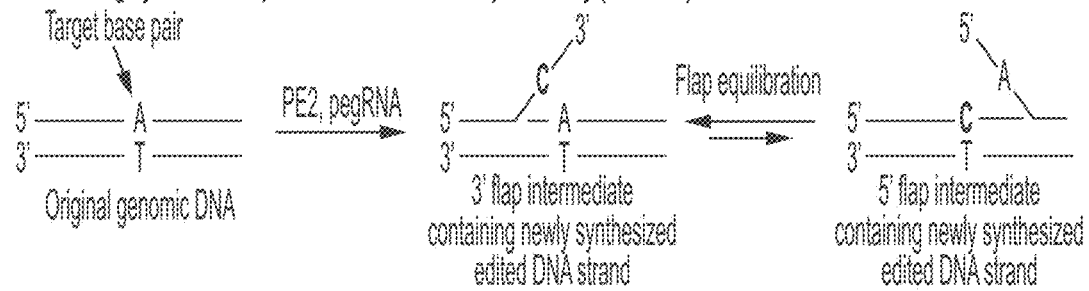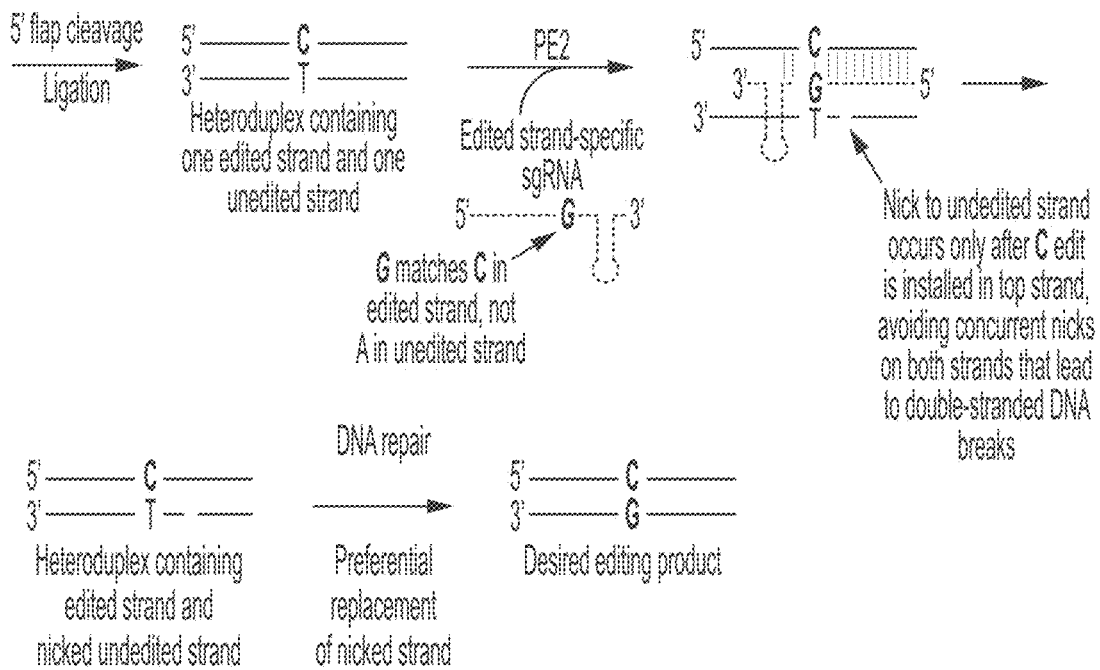
FIG. 1I

Polymerase-dependent synthesis of a replacement strand encoded by the polymerase against the DNA synthesis template and which contains a desired edit. The mechanism is envisioned to operate similarly to prime editing. Additional factors or effectors may be added *in trans* or as fusions to facilitate the reaction as a whole (e.g., (a) a helicase to unwind the DNA at the cut site to make the cut strand with the 3' end available as a primer, (b) a FEN1 to help remove the endogenous strand on the cut strand to drive the reaction towards replacement of the endogenous strand with the synthesized strand, or (c) a nCas9:gRNA complex to create a second site nick on the opposite strand, which may help drive the integration of the synthesize repair through favored cellular repair of the non-edited strand)

FIG. 1K

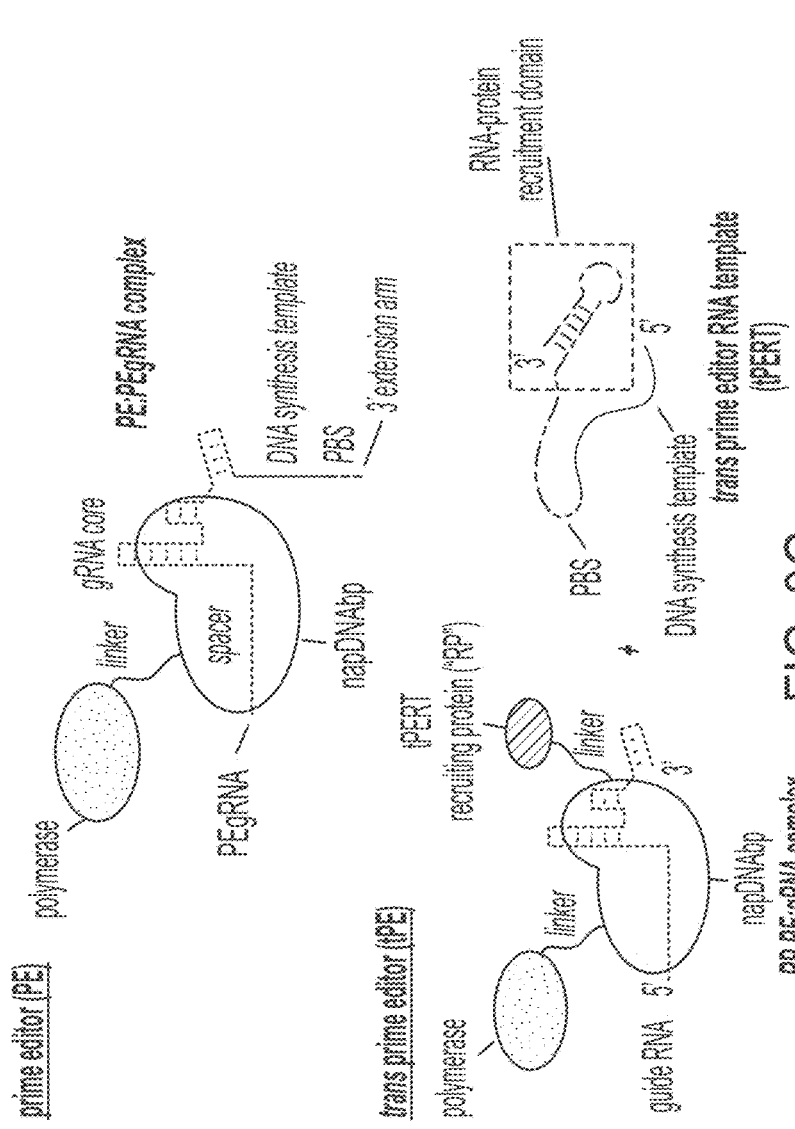
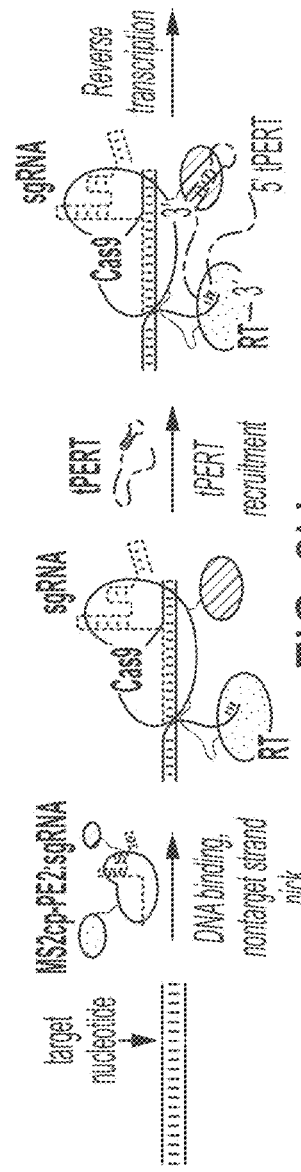
FIG. 3G
FIG. 3H

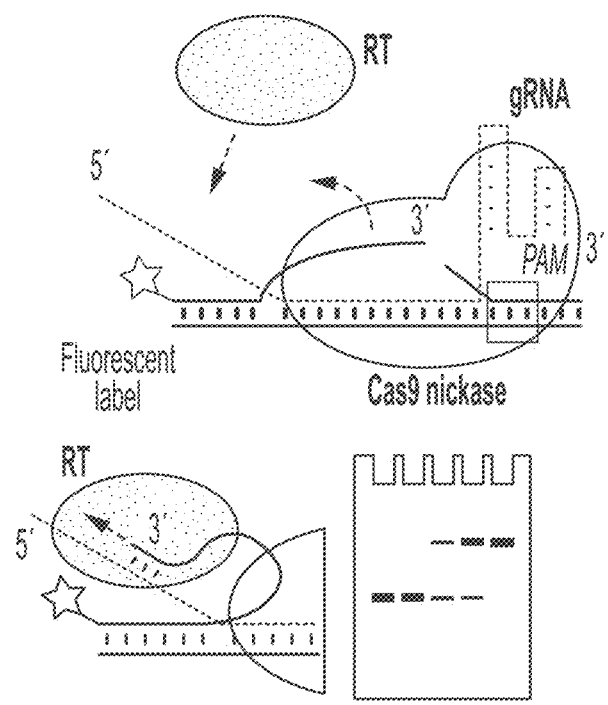
FIG. 4A
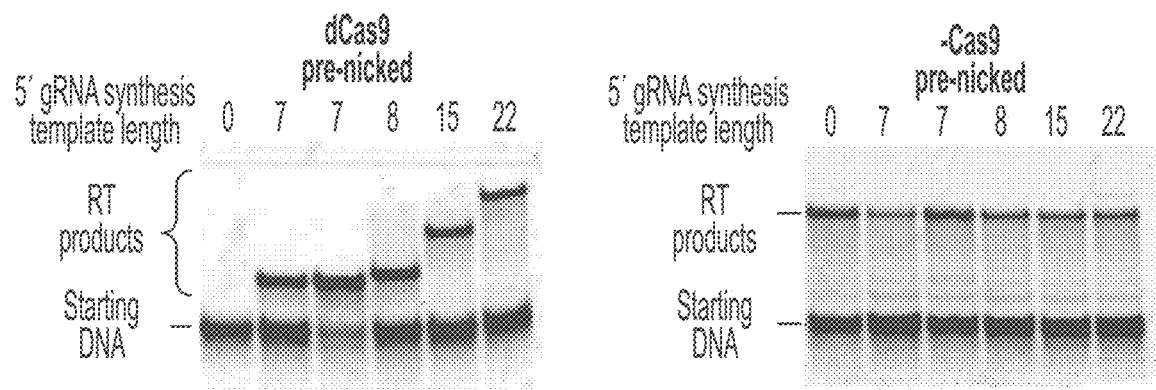
FIG. 4B
FIG. 4C

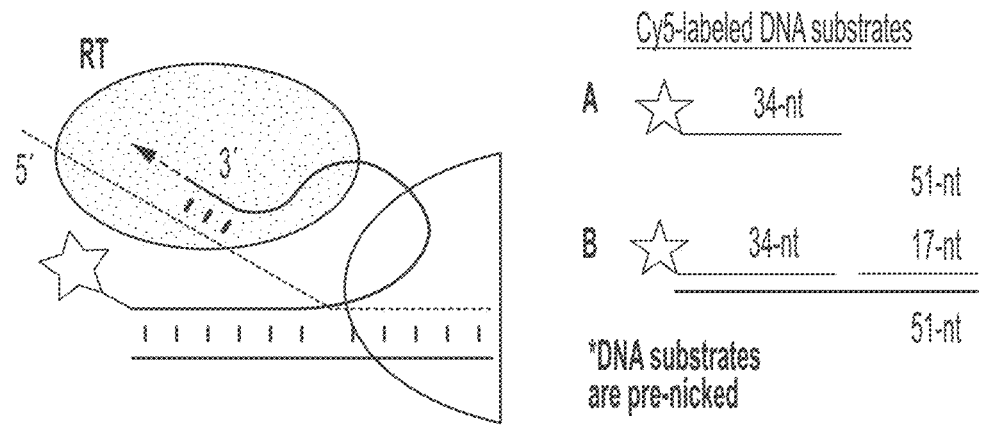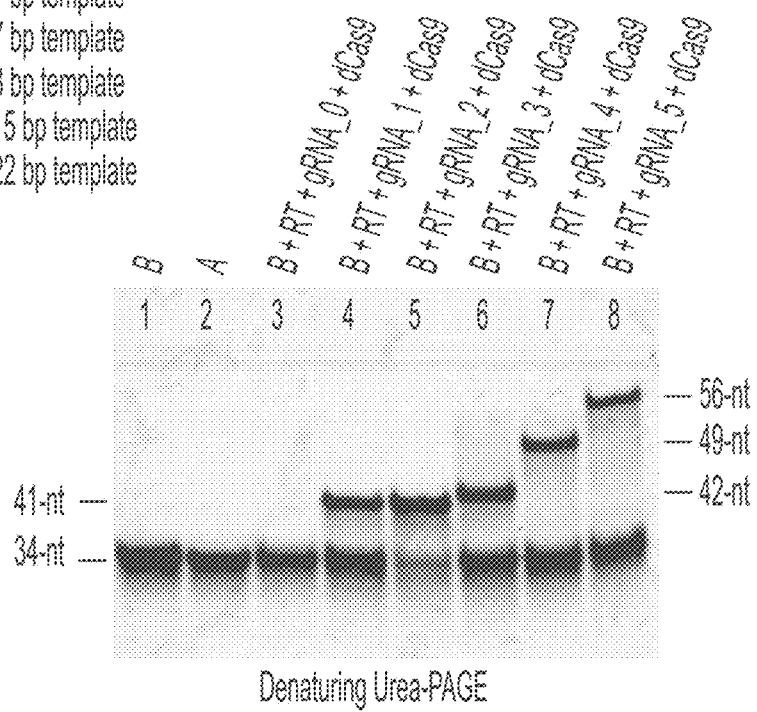
FIG. 5

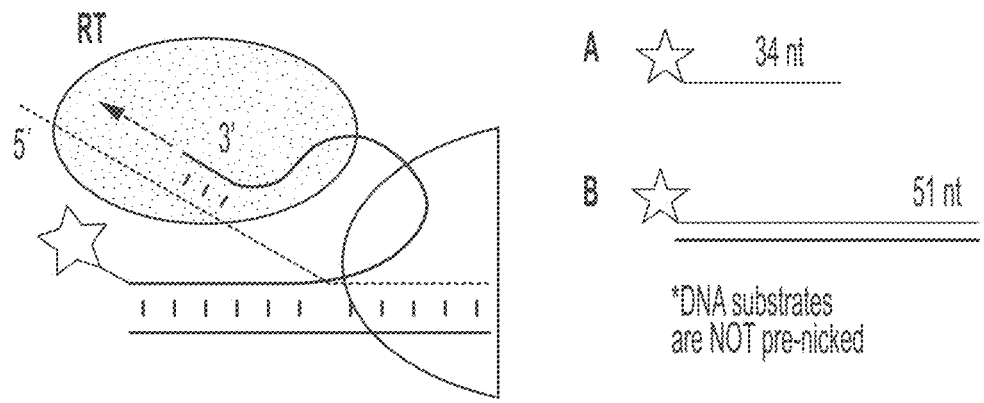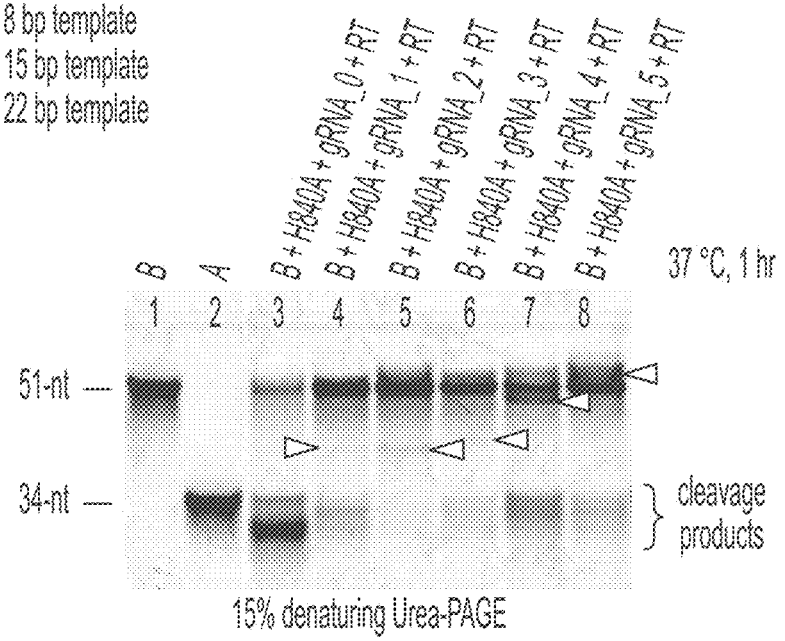
FIG. 6

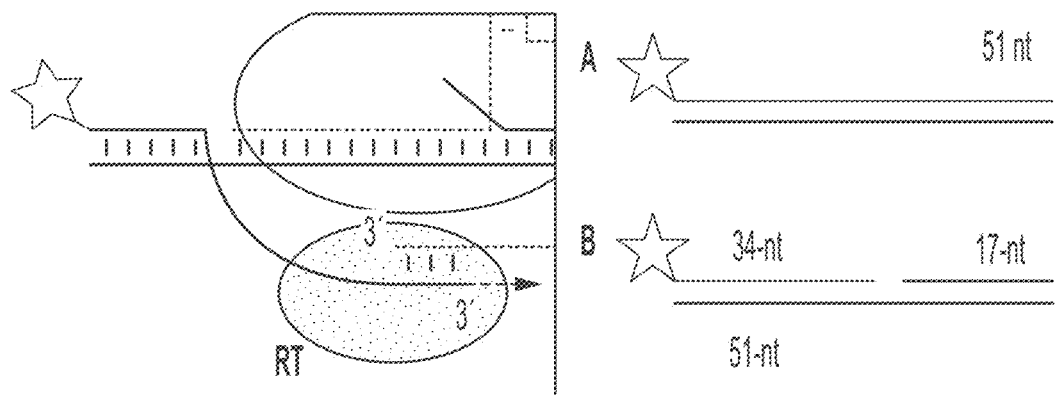
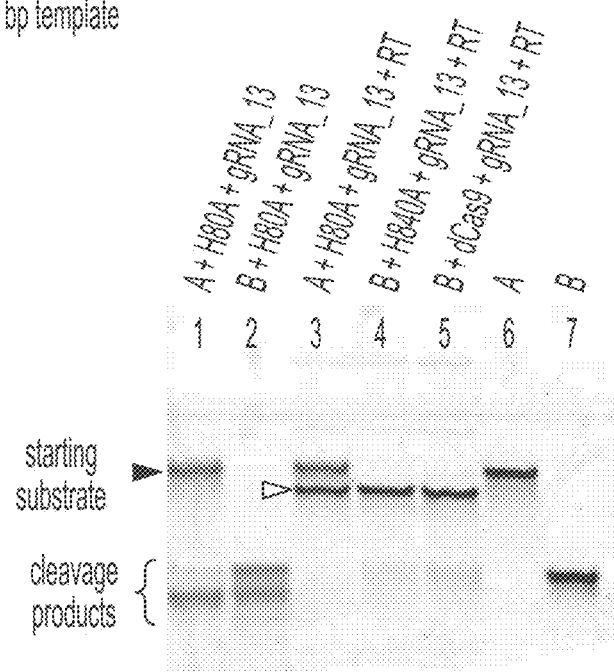
FIG. 7

|  | edit | Endogenous polymorphism in HEK293T cells |
| --- | --- | --- |

SEQ ID NOs:

| 791 | T G G G C C C A G A C T G A G C A C G T G A T G G C A G A G G A A A G G A A G | Reference |
| --- | --- | --- |
| 791 | T G G G C C C A G A C T G A G C A C G T G A T G G C A G A G G A A A G G A A G | 64.11% (59189 reads) |
| 792 | T G G G C C C A G A C T G A G C A C G T G A T G G C A A A G G A A A G G A A G | 28.84% (26624 reads) |
| 793 | T G G G C C C A G A C T G A G C A C G A G A T G G C A G A G G A A A G G A A G | 2.86% (2641 reads) |
| 794 | T G G G C C C A G A C T G A G C A C G A G A T G G C A A A G G A A A G G A A G | 0.81% (749 reads) | bold Substitutions
☐ Insertions
- Deletions
--- Predicted cleavage position

FIG. 18

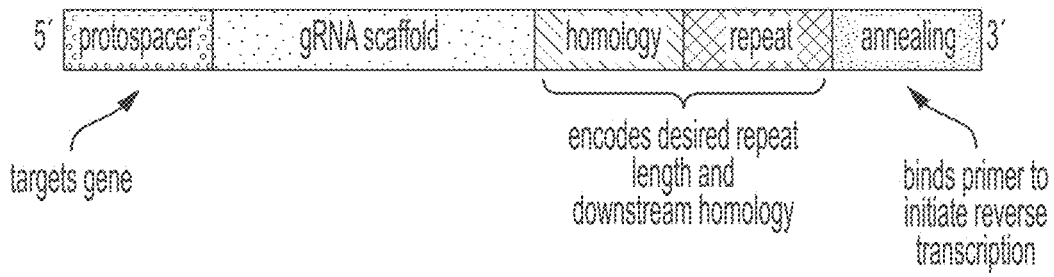
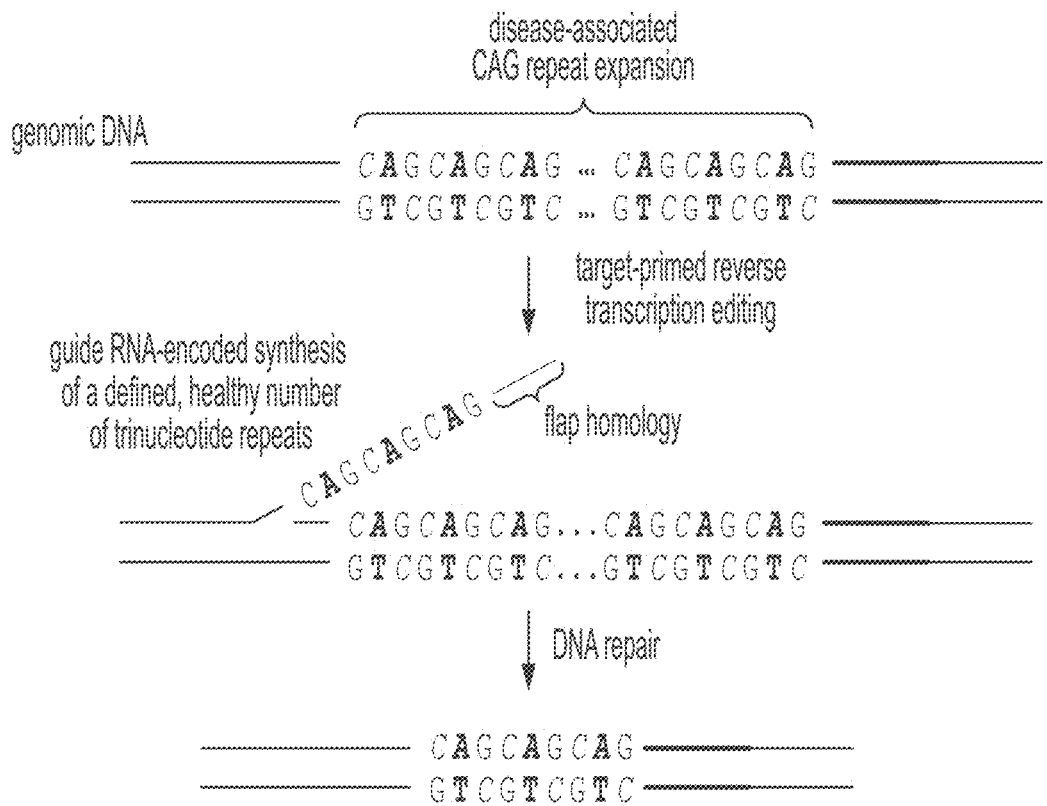
FIG. 23

| | programmable codon deletion and truncations | |
|---|---|---|
| SEQ ID NO: 811 | gfp | NFKIRHNIEDGSVQLADHYQQNTPI |
| SEQ ID NO: 812 | del 15 | NFKI-HNIEDGSVQLADHYQQNTPI |
| SEQ ID NO: 813 | del 16 | NFKIR-NIEDGSVQLADHYQQNTPI |
| SEQ ID NO: 814 | del 18 | NFKIRHN-EDGSVQLADHYQQNTPI |
| SEQ ID NO: 815 | del 8-13 | NFKIRHN------QLADHYQQNTPI |
| SEQ ID NO: 816 | del 1-5 | ------HNIEDGSVQLADHYQQNTPI |
| SEQ ID NO: 817 | del 15-25 | NFKIRHNIEDGSVQ----------- |

FIG. 29D

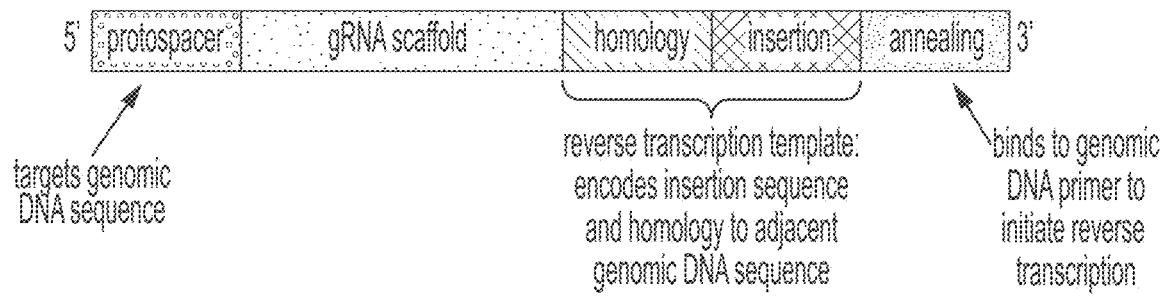
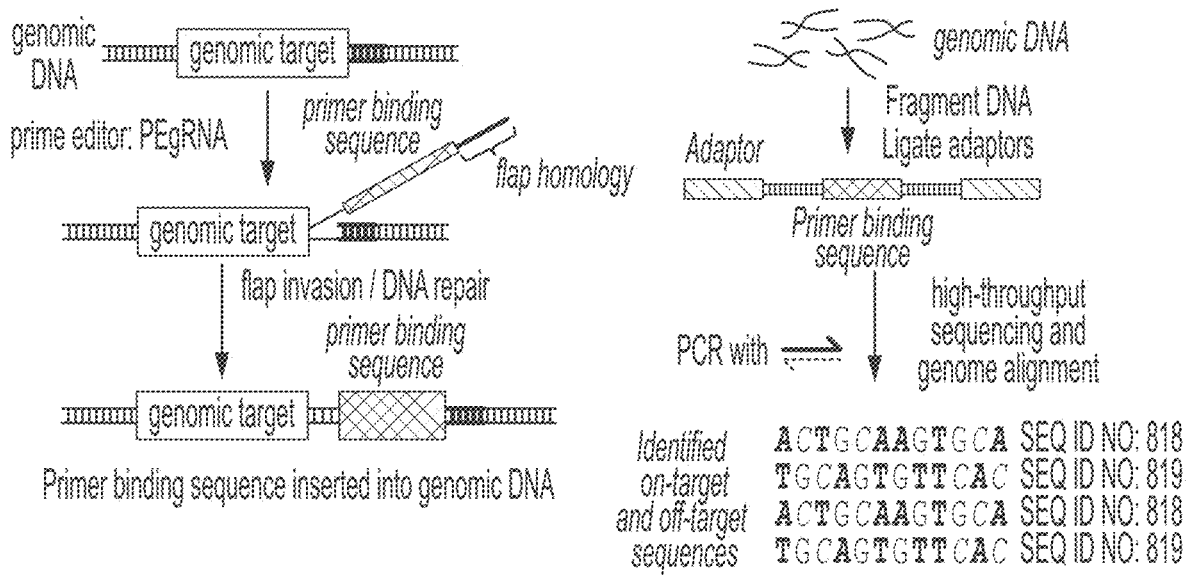
FIG. 33

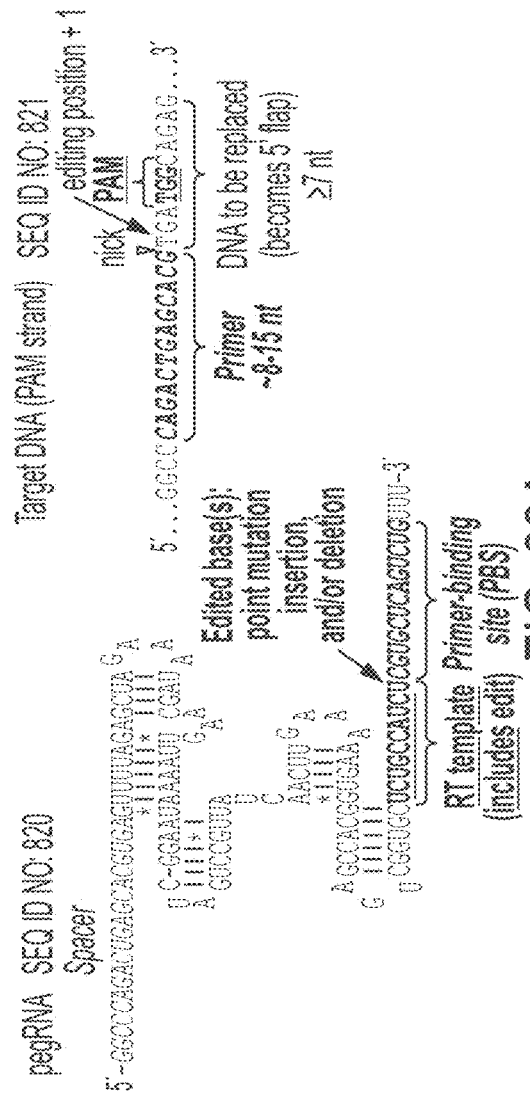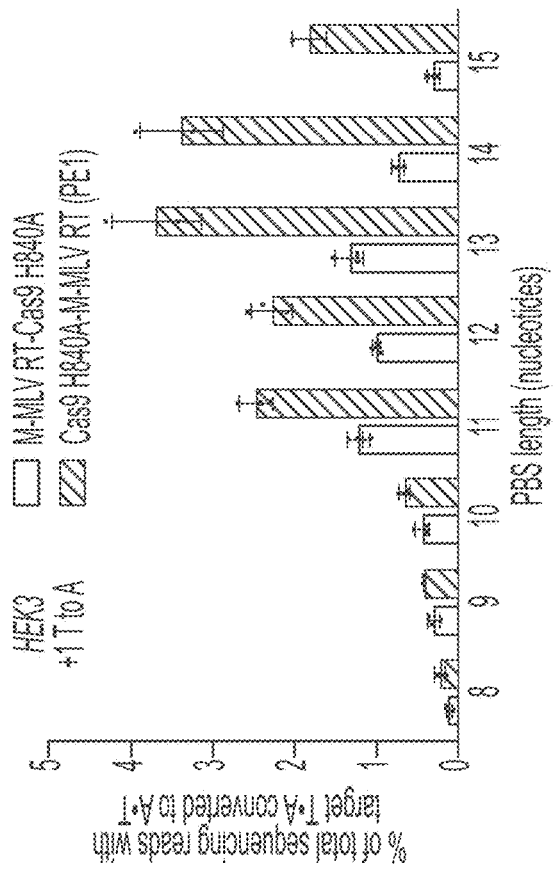
FIG. 39A
FIG. 39B

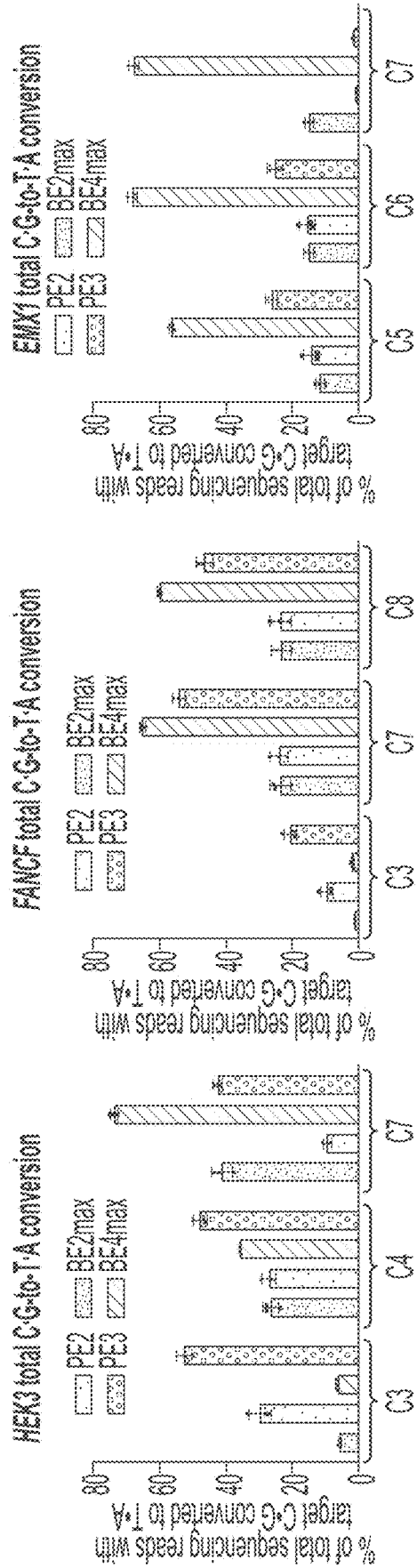
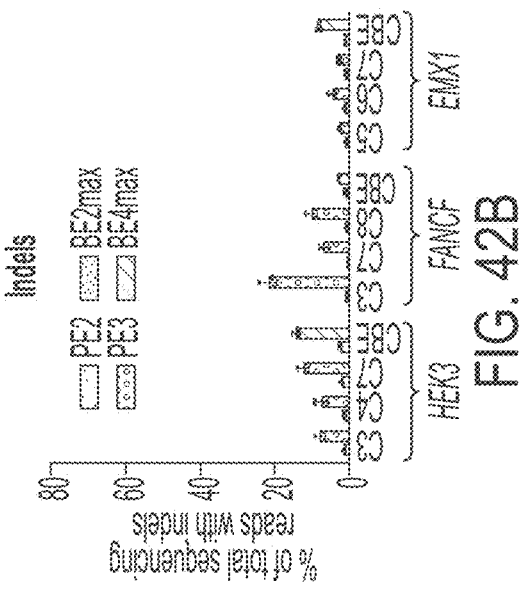
FIG. 42A
FIG. 42B

| | |
|---|---|
| PE1 | Cas9 H840A-M-MLV RT (wt) |
| PE1-M1 | Cas9 H840A-M-MLV RT (D200N) |
| PE1-M2 | Cas9 H840A-M-MLV RT (D200N+L603W) |
| PE1-M3 | Cas9 H840A-M-MLV RT (D200N+L603W+T330P) |
| PE1-M6 | Cas9 H840A-M-MLV RT (D200N+L603W+T330P+D524G+E562Q+D583N) |
| PE1-M15 | Cas9 H840A-M-MLV RT (P51L+S67R+E67K+T197A+H204R+E302K+F309N+W1331F+T330P+L345G+N454K+D524G+D583N+H594Q+D653N) |
| PE1-M3inv | M-MLV RT (D200N+L603W+T330P)-Cas9 H840A |
| PE2 | Cas9 H840A-M-MLV RT (D200N+L603W+T330P+T306K+W313F) |

Line 1

| SEQ ID NO: | | |
|---|---|---|
| 875 | C A C C A T G G T G C A C C T G A C T C C T G A G G A G A A G T C T G C C G T T | -Reference |
| 876 | C A C C A T G G T G C A C C T G A C T C C T G T G G A G A A G T C T G C C G T T | -97.45% (87424 reads) |
| 875 | C A C C A T G G T G C A C C T G A C T C C T G A G G A G A A G T C T G C C G T T | -0.27% (240 reads) |
| 877 | C A C C A T G G C G C A C C T G A C T C C T G T G G A G A A G T C T G C C G T T | -0.24% (212 reads) |

Line 2

| SEQ ID NO: | | |
|---|---|---|
| 875 | C A C C A T G G T G C A C C T G A C T C C T G A G G A G A A G T C T G C C G T T | -Reference |
| 876 | C A C C A T G G T G C A C C T G A C T C C T G T G G A G A A G T C T G C C G T T | -97.16% (63793 reads) |
| 875 | C A C C A T G G T G C A C C T G A C T C C T G A G G A G A A G T C T G C C G T T | -0.36% (239 reads) |
| 877 | C A C C A T G G C G C A C C T G A C T C C T G T G G A G A A G T C T G C C G T T | -0.22% (142 reads) |

Line 3

| SEQ ID NO: | | |
|---|---|---|
| 875 | C A C C A T G G T G C A C C T G A C T C C T G A G G A G A A G T C T G C C G T T | -Reference |
| 876 | C A C C A T G G T G C A C C T G A C T C C T G T G G A G A A G T C T G C C G T T | -97.32% (77514 reads) |
| 875 | C A C C A T G G T G C A C C T G A C T C C T G A G G A G A A G T C T G C C G T T | -0.29% (228 reads) |
| 877 | C A C C A T G G C G C A C C T G A C T C C T G T G G A G A A G T C T G C C G T T | -0.22% (172 reads) |
| 878 | C A C C A T G G T G C A C C T G A C T C C T G T G G A G A A G T C T G T C G T T | -0.21% (167 reads) |

Line 4

| SEQ ID NO: | | |
|---|---|---|
| 875 | C A C C A T G G T G C A C C T G A C T C C T G A G G A G A A G T C T G C C G T T | -Reference |
| 876 | C A C C A T G G T G C A C C T G A C T C C T G T G G A G A A G T C T G C C G T T | -96.94% (70061 reads) |
| 875 | C A C C A T G G T G C A C C T G A C T C C T G A G G A G A A G T C T G C C G T T | -0.58% (419 reads) |
| 877 | C A C C A T G G C G C A C C T G A C T C C T G T G G A G A A G T C T G C C G T T | -0.23% (165 reads) |
| 878 | C A C C A T G G T G C A C C T G A C T C C T G T G G A G A A G T C T G T C G T T | -0.21% (150 reads) |

Protocol to simultaneously clone a spacer sequence (Target Site) and pegRNA 3' extension containing a PBS and RT template into a human U6 promoter pegRNA expression vector:

[Component 1] Undigested pU6-pegRNA-GG-Vector Schematic:

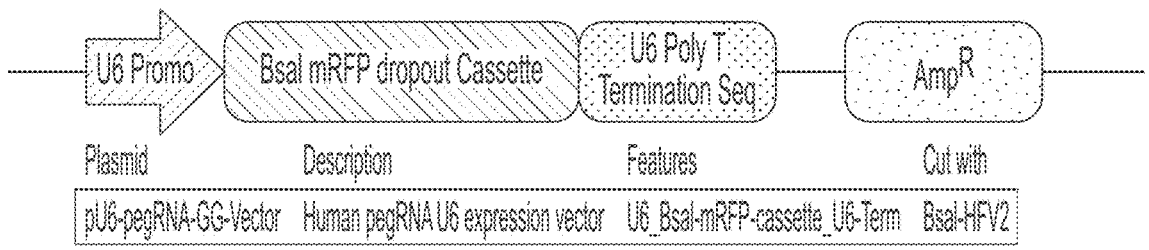

| Plasmid | Description | Features | Cut with |
|---|---|---|---|
| pU6-pegRNA-GG-Vector | Human pegRNA U6 expression vector | U6_BsaI-mRFP-cassette_U6-Term | BsaI-HFV2 |

[Component 2] Ordering oligonucleotides to generate the spacer (target) sequence for human pegRNA vectors:

Top and bottom oligos to be annealed and then assembled into digested pU6-pegRNA-GG-Vector:

SEQ ID NO: 879  5'-CACCNNNNNNNNNNNNNNNNNNNNGTTTT -3'

SEQ ID NO: 880  3'-     NNNNNNNNNNNNNNNNNNNNCAAAATCTC -5'

(The N20 mock protospacer sequence shown can be of variable length, as needed)

[Component 3] Ordering oligonucleotides to generate the SpCas9 sgRNA scaffold for human pegRNA vectors:

Top and bottom oligos to be annealed and then assembled into digested pU6-pegRNA-GG-Vector

(Phos) 5'-AGAGCTAGAAATAGCAAGTTAAAATAAGGCTAGTCCGTTATCAACTTGAAAAAGTGGCACCGAGTCG -3' SEQ ID NO: 881

SEQ ID NO: 882  3'-     GATCTTTATCGTTCAATTTTATTCCGATCAGGCAATAGTTGAACTTTTTCACCGTGGCTCAGCCACG -5' (Phos)

(Note that these oligos must be 5' phosphorylated to permit pegRNA vector assembly)

[Component 4] Ordering oligonucleotides to generate the pegRNA 3' extension containing a PBS and RT template sequence for human pegRNA vectors:

Top and bottom oligos to be annealed and then assembled into digested pU6-pegRNA-GG-Vector:

SEQ ID NO: 883  5'-GTGCNNNNNNNNNNNNNNNNNNNNNNNNNNNNNN -3'

SEQ ID NO: 884  3'-     NNNNNNNNNNNNNNNNNNNNNNNNNNNNNNAAAA -5'

(The N30 mock reverse transcriptase template sequence shown can be of variable length, as needed)

Schematic of final assembled U6 pegRNA expression vector from components 1, 2, 3, and 4:

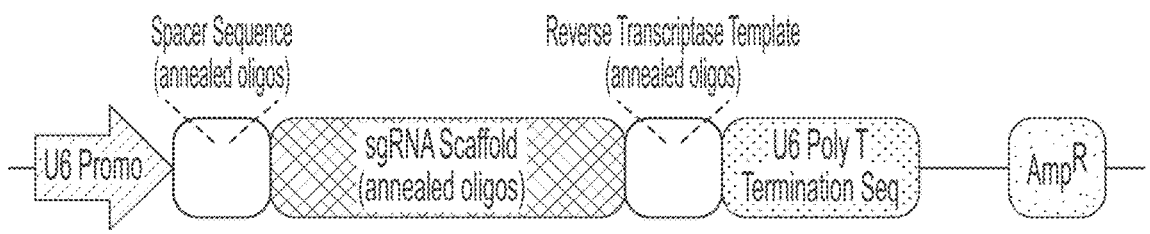

FIG. 54

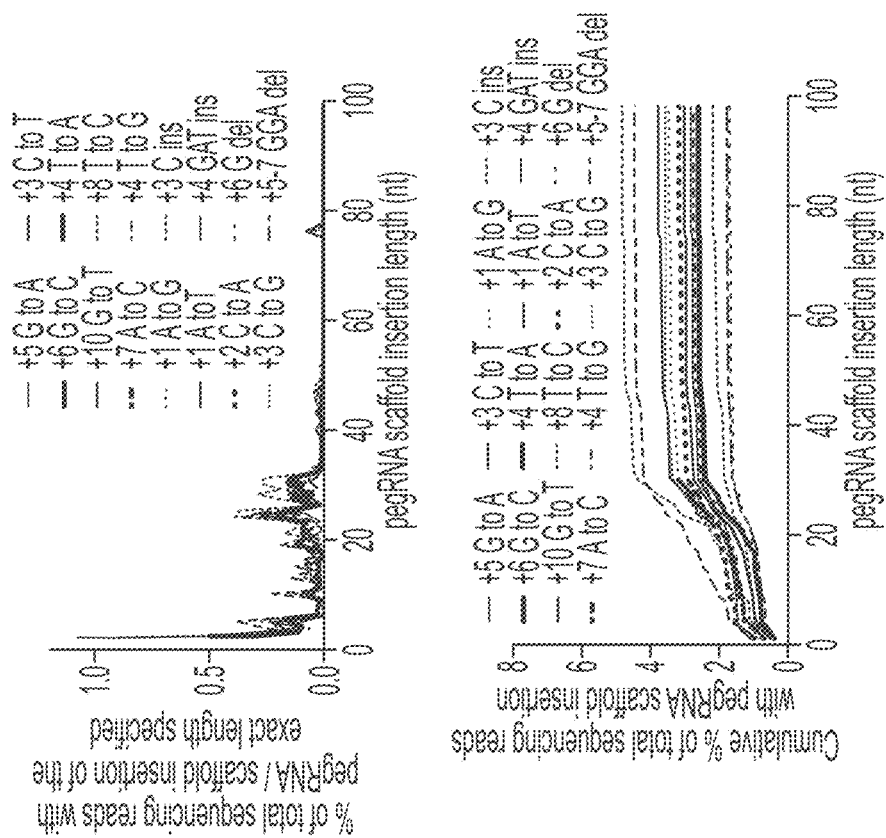
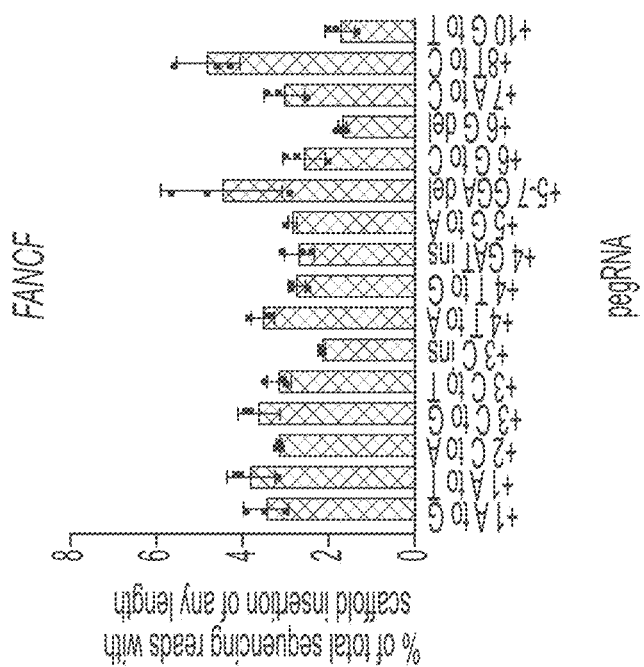
FIG. 56B

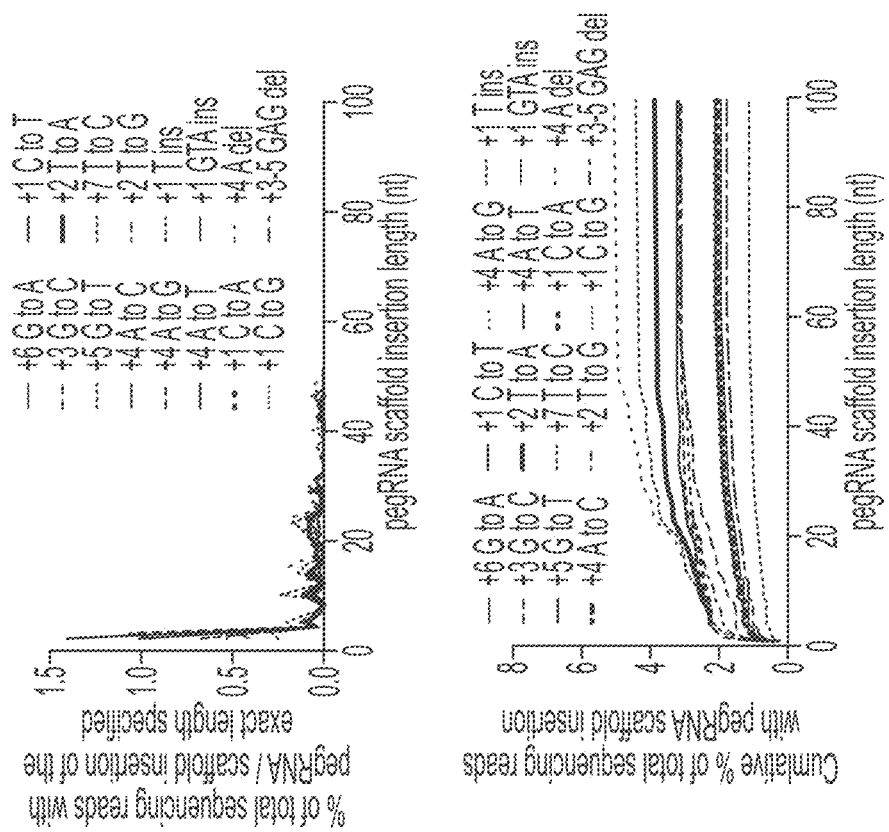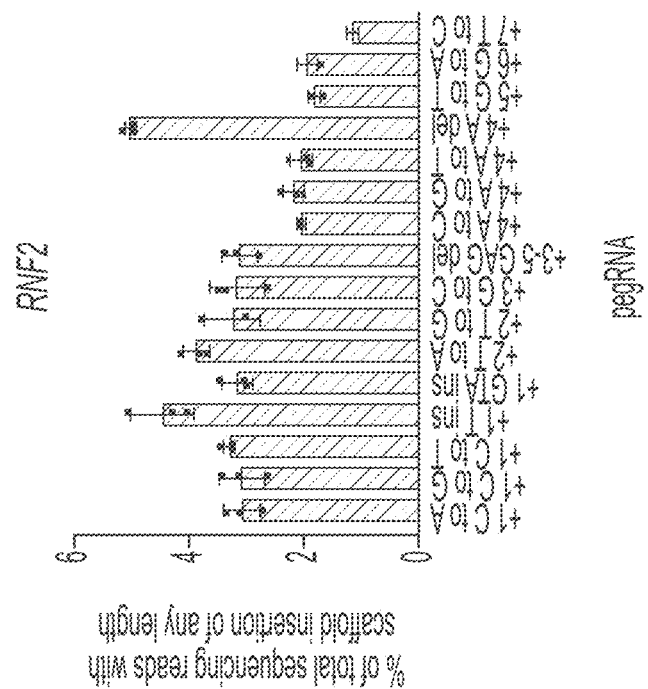
FIG. 56D

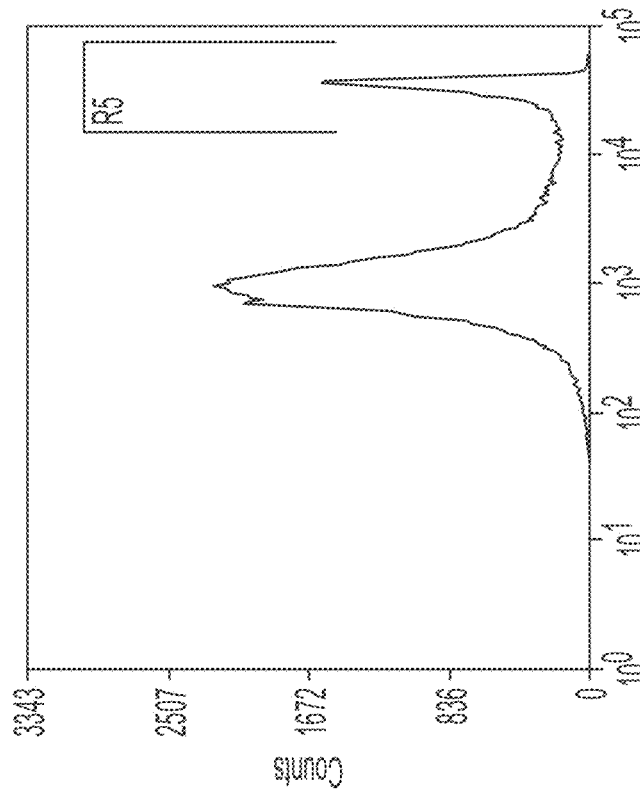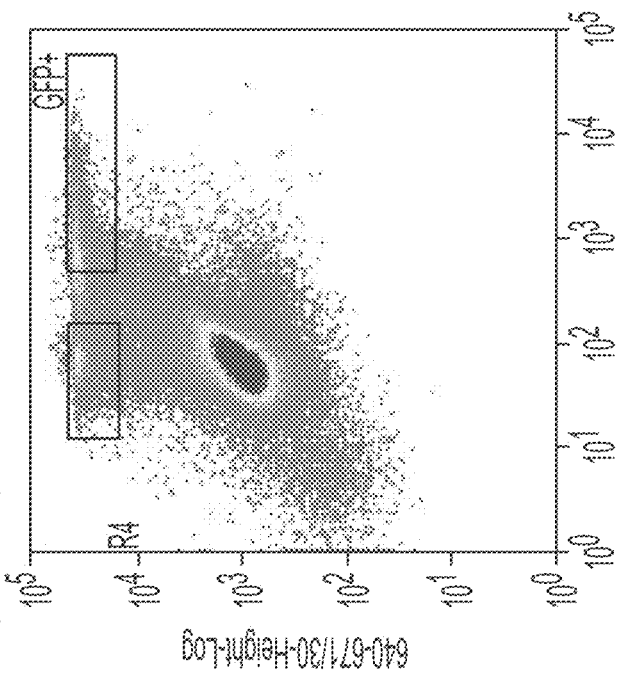
FIG. 58B

Cloning overview

1. Digest pU6-pegRNA-GG-Vector plasmid (component 1) with BsaI and isolate the plasmid fragment (~2.2kb) containing the origin of replication, U6 promoter, U6 poly-T termination sequence, and Amp$^R$ gene
2. Order oligonucleotides for:
   a. The desired spacer (target) sequence flanked by indicated overhangs (component 2)
      i. Use the desired target's 5'-3' sequence for the top strand oligonucleotide (including the 5' CACC and 3' GTTTT overhangs) and use the reverse complement of the target sequence for the bottom strand oligonucleotide (including the 5' CTCTAAAAC overhang). Spacer sequences must begin with a G nucleotide for efficient transcription initiation.
   b. The desired pegRNA 3' extension template flanked by the indicated overhangs (component 3)
      i. Use the RNA sense sequence as the top strand oligonucleotide (featuring the 5' GTGC overhang) and use the reverse complement of this sequence for the bottom strand oligonucleotide (featuring the 5' AAAA overhang).
   c. SpCas9 sgRNA scaffold sequence featuring compatible golden gate overhangs (component 4)
      i. These oligonucleotides are not the complete scaffold sequence, as overhangs from the remaining components contribute several missing nucleotides
      ii. Note: these oligonucleotides <u>must be 5' phosphorylated</u>. Oligonucleotides can be 5' phosphorylated by the manufacturer or 5' phosphorylated enzymatically using T4 PNK (see protocol below)
3. Anneal top and bottom oligonucleotides for components 2, 3, and 4 in separate annealing reactions according to the protocol below. If the SpCas9 sgRNA scaffold sequence (component 4) was not phosphorylated, phosphorylate with T4 PNK.
4. Golden Gate assembly of isolated 2.2-kb fragment from component 1 with components 2, 3, and 4
5. Transform the ligation product into E. coli. The antibiotic resistance conferred by component 1 from the pU6-pegRNA-GG-vector plasmid is ampicillin and carbenicillin resistance.
6. Isolate and sequence plasmids from the resulting clonal transformants

FIG. 59A pegRNA cloning protocol

Step 1: Digest pU6-pegRNA-GG-Vector plasmid (component 1)

Combine the following in a PCR tube:

| | |
|---|---|
| 2000 ng pU6-pegRNA-GG-Vector (component 1) | X µL |
| Bsa1-HFv2 (NEB) | 1.0 µL |
| 10x Cutsmart Buffer | 3.0 µL |
| H$_2$O | to 30.0 µL |
| Total reaction volume | 30.0 µL |

Incubate at 37 °C for 4-16 hours
Isolate ~2.2-kb fragment from cut plasmid.

FIG. 59B

Steps 2 and 3: Order and anneal oligonucleotide parts (components 2, 3, and 4)

<u>Materials</u>

Annealing buffer: H$_2$O supplemented with 10 mM Tris-Cl pH 8.5 and 50 mM NaCl
   Complementary oligonucleotide pairs <u>Protocol</u>

Combine the following in a PCR tube:

| | |
|---|---|
| Top oligonucleotide, 100 µM | 1.0 µL |
| Bottom oligonucleotide, 100 µM | 1.0 µL |
| Annealing buffer (components 2, 3, and 4) | 23.0 µL |
| Total reaction volume | 25.0 µL |

In thermocycler, heat at 95 °C for 3 minutes, then cool gradually (0.1 °C/s) to 22 °C Dilute annealed oligonucleotides 1:4 by adding 75 µL H$_2$O. The final concentration of each oligonucleotide will be 1 µM after this dilution. Do not dilute the sgRNA scaffold (component 4) if phosphorylating by PNK in step 2.5.

FIG. 59C

Step 2.b.ii.: sgRNA scaffold phosphorylation (unnecessary if oligonucleotides were purchased phosphorylated)

<u>Protocol</u>

Combine the following in a PCR tube:

| | |
|---|---|
| 4 µM oligonucleotide duplex from step 1 | 6.25 µL |
| 10x T4 DNA ligase buffer (NEB) | 2.50 µL |
| T4 PNK (NEB) | 0.50 µL |
| H$_2$O | 15.75 µL |
| Total reaction volume | 20.0 µL |

In thermocycler, incubate at 37 °C for 60 minutes
Following this phosphorylation, annealed scaffold oligonucleotides are now at a concentration of 1 µM.
Proceed to step 3.

FIG. 59D

Step 4: peg RNA assembly
pegRNA, Golden Gate assembly reaction

| | |
|---|---|
| Digested pU6-pegRNA-GG plasmid-vector | 1.00 µL @ 30 ng/µL |
|   - Pre-cut, isolated 2.2-kb fragment | |
| Annealed protospacer oligonucleotides (component 2) | 1.00 µL @ 1 µM |
| Annealed pegRNA 3'-extension oligonucleotides (component 4) | 1.00 µL @ 1 µM |
| sgRNA scaffold annealed oligonucleotides (component 3) | 1.00 µL @ 1 µM |
|   - Oligonucleotides *must be phosphorylated* | |
| BsaI-HFv2 (NEB) | 0.25 µL |
| T4 DNA ligase (NEB) | 0.50 µL |
| 10x T4 DNA ligase buffer (NEB) | 1.00 µL |
| $H_2O$ | 4.25 µL |
| Total reaction volume: | 10.0 µL |

Incubate at room temperature for 10 min
Following incubation, perform the following program in a thermocycler:
5 min at 37 °C then 5 min at 80 °C then hold at 12 °C

FIG. 59E

Steps 5 and 6: Transformation of assembled plasmids
Transform 1 µL of the 10 µL assembly reaction into 10 µL of competent cells. The desired transformants will be resistant to ampicillin and carbenicillin.

The following diagram summarizes the pegRNA cloning protocol.

FIG. 59F pegRNA Cloning by Golden Gate Assembly

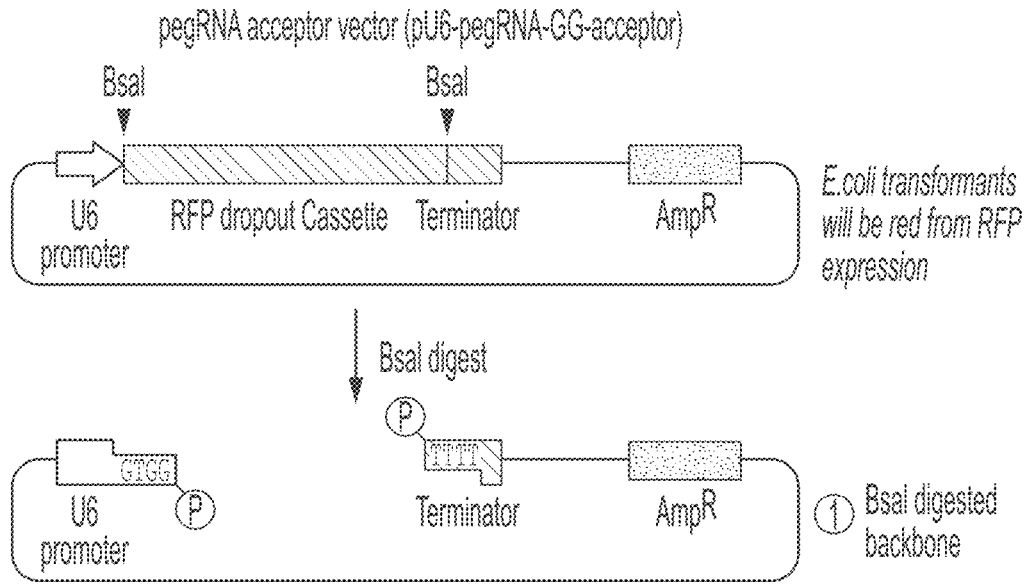

② pegRNA spacer annealed oligos
SEQ ID NO: 879

5' CACCNNNNNNNNNNNNNNNNNNNNGTTTT 3'
3'     NNNNNNNNNNNNNNNNNNNNCAAAATCTC 5'

SEQ ID NO: 880

③ pegRNA 3' extension annealed oligos
SEQ ID NO: 883

5' GTGCNNNNNNNNNNNNNNNNNNNNNNNNNN 3'
3'     NNNNNNNNNNNNNNNNNNNNNNNNNNAAAA 5'

SEQ ID NO: 884

④ pegRNA scaffold annealed oligos (5' phosphorylated)
SEQ ID NO: 881

5' [Phos]-AGAGCTAGAAATAGCAAGTTAAAATAAGGCTAGTCCGTTATCAACTTGAAAAAGTGGCACCGAGTCG 3'
3'        GATCTTTATCGTTCAATTTTATTCCGATCAGGCAATAGTTGAACTTTTTCACCGTGGCTCAGCCACG-[Phos] 5'

SEQ ID NO: 882 *(Note that these oligos must be 5' phosphorylated to permit pegRNA vector assembly)*

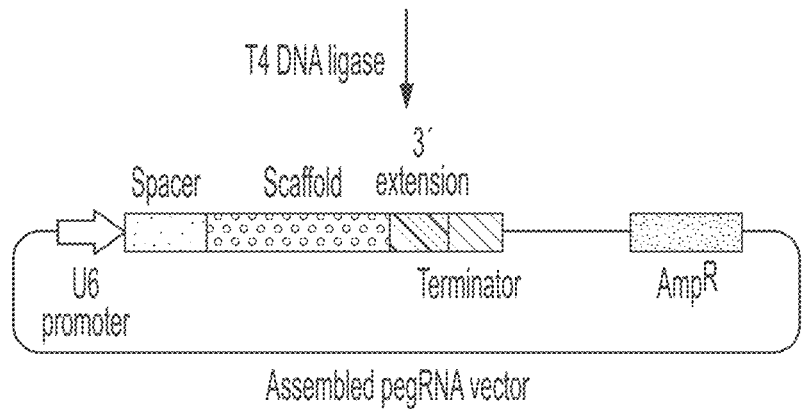

FIG. 59G

```
sgRNA scaffold sequence search ## import pandas as pd
import Bio as bio
from Bio import SeqIO
import glob generates list of fastq files to analyze
sources = glob.glob('*.fastq')

#reads the fastq files into a dictionary with the file names as keys
fastqdict = {}
for i in range(len(sources)):
    temp = list(SeqIO.parse(sources[i], "fastq"))
    fastqdict[sources[i]] = [str(temp[k].seq) for k in range(len(temp))]

#the referenced sequence to be searched for is entered into the following dictionary with
#an appropriate key
scaffdict =
{'HEK3':'CAGAGGACCGACTCGGTCCCACTTTTTCAAGTTGATAACGGACTAGCCTTATTTTAACTT
GCTATTTCTAGCTCTAAAACTCACGTGCTCAGTCTGGGCCGGTG',(SEQ ID NO: 885)
'EMX1':'ATCACGCACCGACTCGGTGCCACTTTTTCAAGTTGATAACGGACTAGCCTTATTTTAACT
TGCTATTTCTAGCTCTAAAACTTCTTCTTCTGCTCGGACTCGGTG',(SEQ ID NO: 886)
'FANCF':'TTTCCGCACCGACTCGGTGCCACTTTTTCAAGTTGATAACGGACTAGCCTTATTTTAAC
TTGCTATTTCTAGCTCTAAAACGGTGCTGCAGAAGGGATTCCGGTG',(SEQ ID NO: 887)
'RNF2':'TCGTTGCACCGACTCGGTGCCACTTTTTCAAGTTGATAACGGACTAGCCTTATTTTAACTT
GCTATTTCTAGCTCTAAAACCAGGTAATGACTAAGATGACGGTG'}(SEQ ID NO: 888)

#matches and counts iterative slices of the reference string to the appropriate fastq files
#reference key must be contained in the name of the fastq file
#generated values represent cumulative counts for a minimum degree of sgRNA integration
#i.e. a given value x means x reads contain y or more bases of the scaffold
resultdict = dict.fromkeys(sources)
for key in fastqdict:
    for scaffold in scaffdict:
        if scaffold in str(key):
            resultlist = []
            for j in range(len(scaffdict[scaffold])):
```

FIG. 60A

```
            extent = scaffdict[scaffold][0:(j+1)]
            counter = 0
            for i in range(len(fastqdict[key])):
                if extent in fastqdict[key][i]:
                    counter = counter + 1
            resultlist.append(counter)
        resultdict[key]=resultlist writes the results into a dataframe indexed from 1
resultdf = pd.DataFrame.from_dict(resultdict)
resultdf = resultdf.reindex(sorted(resultdf.columns), axis=1)
resultdf.index = range(1,len(resultdf)+1)

#converts the cumulative count values into specific counts
#i.e. a given value x means x reads contain exactly y bases of the scaffold
resultdf2=resultdf.copy()
for entry in resultdf:
    for i in range(1,len(resultdf[entry])+1):
        try:
            resultdf2[entry][i] = resultdf[entry][i]-resultdf[entry][i+1]
        except:
            resultdf2[entry][i] = resultdf[entry][i]

#converts the specific counts values into frequencies
resultdf3=resultdf2.copy()
for entry in resultdf3:
    resultdf3[entry]=resultdf2[entry].div(resultdf[entry][1])*100 reads the results into excel files
resultdf.to_excel('cumulativecounts.xlsx')
resultdf2.to_excel('specificcounts.xlsx')
resultdf3.to_excel('specificfrequencies.xlsx')
```

FIG. 60B

Starting allele
(SEQ ID NO: 892)
5'- TATTATTACTCTATGTTCTATTTAAGTTTTCATGTTCTAAAAATGTATCCCAGTTTACACGTCTCAT
ATAATAATGAGATACAAGATAAATTCAAAAGTACAAGATTTTTACATAGGGTCAAATGTGCAGAGTA
(SEQ ID NO: 893)                           Edit Target (A•T to C•G)
ATGCCCCTTGGCAGTCATCTTAGTCATTACCTGAGGTGTTCGTTGTAACTCATATAAACTGAGTTCC
TACGGGGAACCGTCAGTAGAATCAGTAATGGACTCCACAAGCAACATTGAGTATATTTGACTCAAGG CATGTTTTGCTTAATGGTTGAGTTCCGTTTGTCTGCACAGCCTGAGACATTGCTGGAAATAAAGAAG -3'
GTACAAAACGAATTACCAACTCAAGGCAAACAGACGTGTCGGACTCTGTAACGACCTTTATTTCTTC

FIG. 70A

Starting allele
(SEQ ID NO: 892)
5'- TATTATTACTCTATGTTCTATTTAAGTTTTCATGTTCTAAAAATGTATCCCAGTTTACACGTCTCAT
ATAATAATGAGATACAAGATAAATTCAAAAGTACAAGATTTTTACATAGGGTCAAATGTGCAGAGTA
(SEQ ID NO: 893)                           NGG PAM 1
ATGCCCCTTGGCAGTCATCTTAGTCATTACCTGAGGTGTTCGTTGTAACTCATATAAACTGAGTTCC
TACGGGGAACCGTCAGTAGAATCAGTAATGGACTCCACAAGCAACATTGAGTATATTTGACTCAAGG
                            NGG PAM 2

CATGTTTTGCTTAATGGTTGAGTTCCGTTTGTCTGCACAGCCTGAGACATTGCTGGAAATAAAGAAG -3'
GTACAAAACGAATTACCAACTCAAGGCAAACAGACGTGTCGGACTCTGTAACGACCTTTATTTCTTC

FIG. 70B

Starting allele
(SEQ ID NO: 892)
5'- TATTATTACTCTATGTTCTATTTAAGTTTTCATGTTCTAAAAATGTATCCCAGTTTACACGTCTCAT
ATAATAATGAGATACAAGATAAATTCAAAAGTACAAGATTTTTACATAGGGTCAAATGTGCAGAGTA
(SEQ ID NO: 893)                  nick for PAM 1
                                        ▼
ATGCCCCTTGGCAGTCATCTTAGTCATTACCTGAGGTGTTCGTTGTAACTCATATAAACTGAGTTCC
TACGGGGAACCGTCAGTAGAATCAGTAATGGACTCCACAAGCAACATTGAGTATATTTGACTCAAGG
                                 ▲
                           nick for PAM 2
CATGTTTTGCTTAATGGTTGAGTTCCGTTTGTCTGCACAGCCTGAGACATTGCTGGAAATAAAGAAG -3'
GTACAAAACGAATTACCAACTCAAGGCAAACAGACGTGTCGGACTCTGTAACGACCTTTATTTCTTC

FIG. 70C

Starting allele
(SEQ ID NO: 892)
5'- TATTATTACTCTATGTTCTATTTAAGTTTTCATGTTCTAAAAATGTATCCCAGTTTACACGTCTCAT
    ATAATAATGAGATACAAGATAAATTCAAAAGTACAAGATTTTTACATAGGGTCAAATGTGCAGAGTA
(SEQ ID NO: 893)
                              Spacer         ▼
    ATGCCCCTTGGCAGTCATCTTAGTCATTACCTGAGGTGTTCGTTGTAACTCATATAAACTGAGTTCC
    TACGGGGAACCGTCAGTAGAATCAGTAATGGACTCCACAAGCAACATTGAGTATATTTGACTCAAGG CATGTTTTGCTTAATGGTTGAGTTCCGTTTGTCTGCACAGCCTGAGACATTGCTGGAAATAAAGAAG -3'
    GTACAAAACGAATTACCAACTCAAGGCAAACAGACGTGTCGGACTCTGTAACGACCTTTATTTCTTC

| Spacer = GTCATCTTAGTCATTACCTG |   FIG. 70D

Starting allele
(SEQ ID NO: 892)
5'- TATTATTACTCTATGTTCTATTTAAGTTTTCATGTTCTAAAAATGTATCCCAGTTTACACGTCTCAT
    ATAATAATGAGATACAAGATAAATTCAAAAGTACAAGATTTTTACATAGGGTCAAATGTGCAGAGTA
(SEQ ID NO: 893)         PBS complement  ▼
    ATGCCCCTTGGCAGTCATCTTAGTCATTACCTGAGGTGTTCGTTGTAACTCATATAAACTGAGTTCC
    TACGGGGAACCGTCAGTAGAATCAGTAATGGACTCCACAAGCAACATTGAGTATATTTGACTCAAGG CATGTTTTGCTTAATGGTTGAGTTCCGTTTGTCTGCACAGCCTGAGACATTGCTGGAAATAAAGAAG -3'
    GTACAAAACGAATTACCAACTCAAGGCAAACAGACGTGTCGGACTCTGTAACGACCTTTATTTCTTC

| PBS = GTAATGACTAAGATG |   FIG. 70E

Desired allele
(SEQ ID NO: 892)
5'- TATTATTACTCTATGTTCTATTTAAGTTTTCATGTTCTAAAAATGTATCCCAGTTTACACGTCTCAT
    ATAATAATGAGATACAAGATAAATTCAAAAGTACAAGATTTTTACATAGGGTCAAATGTGCAGAGTA
(SEQ ID NO: 893)                        RT template complement
    ATGCCCCTTGGCAGTCATCTTAGTCATTACCTGCGGTGTTCGTTGTAACTCATATAAACTGAGTTCC
    TACGGGGAACCGTCAGTAGAATCAGTAATGGACGCCACAAGCAACATTGAGTATATTTGACTCAAGG
                                     Edit CATGTTTTGCTTAATGGTTGAGTTCCGTTTGTCTGCACAGCCTGAGACATTGCTGGAAATAAAGAAG -3'
    GTACAAAACGAATTACCAACTCAAGGCAAACAGACGTGTCGGACTCTGTAACGACCTTTATTTCTTC

| RT template = AACGAACACCGCAG |   FIG. 70F

Full pegRNA

```
           Spacer                              RT template           PBS
5'- GTCATCTTAGTCATTACCTG -Scaffold- AACGAACACCGCAGGTAATGACTAAGATG -3'
    (SEQ ID NO: 894)                 (SEQ ID NO: 895)
Scaffold = GTTTTAGAGCTAGAAATAGCAAGTTAAAATAAGGCTAGTCCGTTATCAACTTGAAAAAGTGGCACCGAGTCGGTGC
           (SEQ ID NO: 896)
```

FIG. 70G

Starting allele
(SEQ ID NO: 892)

```
5'- TATTATTACTCTATGTTCTATTTAAGTTTTCATGTTCTAAAAATGTATCCCAGTTTACACGTCTCAT
    ATAATAATGAGATACAAGATAAATTCAAAAGTACAAGATTTTTACATAG[GT]CAAATGTGCAGAGTA
    (SEQ ID NO: 893)                                       ▲

ATGCCCCTTGGCAGTCATCTTAGTCATTACCTGÅGGTGTTCGTTGTAACTCATATAAACTGAGTTCC
    TACGG[GA]CCGTCAGTAGAATCAGTAATGGACTCCACAAGCAACATTGAGTATATTTGACTCAA[GG]
         ▲    Non-edited strand NGG PAMs and nick sites (example options)

CATGTTTTGCTTAATGGTTGAGTTCCGTTTGTCTGCACAGCCTGAGACATTGCTGGAAATAAAGAAG -3'
    [GT]ACAAAACGAATTACCAACTCAA[GG]AAACAGACGTGTCGGACTCTGTAACGACCTTTATTCTTC
       ▲                        ▲
        Nicking-sgRNA protospacers
           (example options)
```

FIG. 70H

Desired allele
(SEQ ID NO: 892)

```
5'- TATTATTACTCTATGTTCTATTTAAGTTTTCATGTTCTAAAAATGTATCCCAGTTTACACGTCTCAT
    ATAATAATGAGATACAAGATAAATTCAAAAGTACAAGATTTTTACATAGGGTCAAATGTGCAGAGTA
    (SEQ ID NO: 893)                                      Edit ATGCCCCTTGGCAGTCATCTTAGTCATTACCTGCGGTGTTCGTTGTAACTCATATAAACTGAGTTCC
    TACGGGGAACCGTCAGTAGAATCAGTAAT[GGA]CGCCACAAGCAACATTGAGTATATTTGACTCAAGG
                                                PE3b protospacer CATGTTTTGCTTAATGGTTGAGTTCCGTTTGTCTGCACAGCCTGAGACATTGCTGGAAATAAAGAAG -3'
    GTACAAAACGAATTACCAACTCAAGGCAAACAGACGTGTCGGACTCTGTAACGACCTTTATTCTTC

[Spacer = GTGAGTTACAACGAACACCGC]
```

FIG. 70I

METHODS AND COMPOSITIONS FOR PRIME EDITING NUCLEOTIDE SEQUENCES

RELATED APPLICATIONS AND INCORPORATION BY REFERENCE

This application claims priority under 35 U.S.C. §§ 120 and 365(c) to and is a continuation of International PCT Application PCT/US2020/023712, filed Mar. 19, 2020, which claims priority under 35 U.S.C. § 119(e) to U.S. Provisional Application No. 62/820,813, filed Mar. 19, 2019, U.S. Provisional Application No. 62/858,958, filed Jun. 7, 2019, U.S. Provisional Application No. 62/889,996, filed Aug. 21, 2019, U.S. Provisional Application No. 62/922,654, filed Aug. 21, 2019, U.S. Provisional Application No. 62/913,553, filed Oct. 10, 2019, U.S. Provisional Application No. 62/973,558, filed Oct. 10, 2019, U.S. Provisional Application No. 62/931,195, filed Nov. 5, 2019, U.S. Provisional Application No. 62/944,231, filed Dec. 5, 2019, U.S. Provisional Application No. 62/974,537, filed Dec. 5, 2019, U.S. Provisional Application No. 62/991,069, filed Mar. 17, 2020, and U.S. Provisional Application No. 63/100,548, filed Mar. 17, 2020, the entire contents of each of which is incorporated herein by reference.

GOVERNMENT SUPPORT

This invention was made with government support under grant numbers U01AI142756, RM1HG009490, R01EB022376, and R35GM118062 awarded by the National Institutes of Health. The government has certain rights in the invention.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Jul. 14, 2021, is named B119570098US00-SUBSEQ-GJM.txt and is 2,890,242 bytes in size.

BACKGROUND OF THE INVENTION

Pathogenic single nucleotide mutations contribute to approximately 50% of human diseases for which there is a genetic component,[7] according to some estimates. Unfortunately, treatment options for patients with these genetic disorders remain extremely limited, despite decades of gene therapy exploration[8]. Perhaps the most parsimonious solution to this therapeutic challenge is direct correction of single nucleotide mutations in patient genomes, which would address the root cause of disease and would likely provide lasting benefit. Although such a strategy was previously unthinkable, recent improvements in genome editing capabilities brought about by the advent of the CRISPR/Cas system[9] have now brought this therapeutic approach within reach. By straightforward design of a guide RNA (gRNA) sequence that contains ~20 nucleotides complementary to the target DNA sequence, nearly any conceivable genomic site can be specifically accessed by CRISPR associated (Cas) nucleases[1,2]. To date, several monomeric bacterial Cas nuclease systems have been identified and adapted for genome editing applications[10]. This natural diversity of Cas nucleases, along with a growing collection of engineered variants[11-14], offers fertile ground for developing new genome editing technologies.

While gene disruption with CRISPR is now a mature technique, precision editing of single base pairs in the human genome remains a major challenge[3]. Homology directed repair (HDR) has long been used in human cells and other organisms to insert, correct, or exchange DNA sequences at sites of double strand breaks (DSBs) using donor DNA repair templates that encode the desired edits[15]. However, traditional HDR has very low efficiency in most human cell types, particularly in non-dividing cells, and competing non-homologous end joining (NHEJ) leads predominantly to insertion-deletion (indel) byproducts[16]. Other issues relate to the generation of DSBs, which can give rise to large chromosomal rearrangements and deletions at target loci[17], or activate the p53 axis leading to growth arrest and apoptosis[18,19].

Several approaches have been explored to address these drawbacks of HDR. For example, repair of single-stranded DNA breaks (nicks) with oligonucleotide donors has been shown to reduce indel formation, but yields of desired repair products remain low[20]. Other strategies attempt to bias repair toward HDR over NHEJ using small molecule and biologic reagents[21-23]. However, the effectiveness of these methods is likely cell-type dependent, and perturbation of the normal cell state could lead to undesirable and unforeseeable effects.

Recently, the inventors, led by Prof. David Liu et al., developed base editing as a technology that edits target nucleotides without creating DSBs or relying on HDR[4-6, 24-27]. Direct modification of DNA bases by Cas-fused deaminase enzymes allows for C.G to T.A, or A.T to G.C, base pair conversions in a short target window (~5-7 bases) with very high efficiency. As a result, base editors have been rapidly adopted by the scientific community. However, the following factors limit their generality for precision genome editing: (1) "bystander editing" of non-target C or A bases within the target window are observed; (2) target nucleotide product mixtures are observed; (3) target bases must be located 15±2 nucleotides upstream of a PAM sequence; and (5) repair of small insertion and deletion mutations is not possible.

Therefore, the development of programmable editors that are flexibly capable of introducing any desired single nucleotide change and/or which could install base pair insertions or deletions (e.g., at least 1, 2, 3, 4, 5, 6, 8, 9, 10, 11, 12, 13, 14, 15, 16, 17, 18, 19, 20, 30, 40, 50, 60, 70, 80, 90, 100, or more base pair insertions or deletions) and/or which could alter or modify the nucleotide sequence at a target site with high specificity and efficiency would substantially expand the scope and therapeutic potential of genome editing technologies based on CRISPR.

SUMMARY OF THE INVENTION

The present invention describes an entirely new platform for genome editing called "prime editing." Prime editing is a versatile and precise genome editing method that directly writes new genetic information into a specified DNA site using a nucleic acid programmable DNA binding protein ("napDNAbp") working in association with a polymerase (i.e., in the form of a fusion protein or otherwise provided in trans with the napDNAbp), wherein the prime editing system is programmed with a prime editing (PE) guide RNA ("PEgRNA") that both specifies the target site and templates the synthesis of the desired edit in the form of a replacement DNA strand by way of an extension (either DNA or RNA) engineered onto a guide RNA (e.g., at the 5' or 3' end, or at an internal portion of a guide RNA). The replacement strand containing the desired edit (e.g., a single nucleobase substitution) shares the same sequence as the endogenous strand of the target site to be edited (with the exception that it includes the desired edit). Through DNA repair and/or replication machinery, the endogenous strand of the target site is replaced by the newly synthesized replacement strand containing the desired edit. In some cases, prime editing may be thought of as a "search-and-replace" genome editing technology since the prime editors, as described herein, not only search and locate the desired target site to be edited, but at the same time, encode a replacement strand containing a desired edit which is installed in place of the corresponding target site endogenous DNA strand.

The prime editors of the present disclosure relate, in part, to the discovery that the mechanism of target-primed reverse transcription (TPRT) or "prime editing" can be leveraged or adapted for conducting precision CRISPR/Cas-based genome editing with high efficiency and genetic flexibility (e.g., as depicted in various embodiments of FIGS. 1A-1F). TPRT is naturally used by mobile DNA elements, such as mammalian non-LTR retrotransposons and bacterial Group II introns[28,29]. The inventors have herein used Cas protein-reverse transcriptase fusions or related systems to target a specific DNA sequence with a guide RNA, generate a single strand nick at the target site, and use the nicked DNA as a primer for reverse transcription of an engineered reverse transcriptase template that is integrated with the guide RNA. However, while the concept begins with prime editors that use reverse transcriptases as the DNA polymerase component, the prime editors described herein are not limited to reverse transcriptases but may include the use of virtually and DNA polymerase. Indeed, while the application throughout may refer to prime editors with "reverse transcriptases," it is set forth here that reverse transcriptases are only one type of DNA polymerase that may work with prime editing. Thus, wherever the specification mentions "reverse transcriptases," the person having ordinary skill in the art should appreciate that any suitable DNA polymerase may be used in place of the reverse transcriptase. Thus, in one aspect, the prime editors may comprise Cas9 (or an equivalent napDNAbp) which is programmed to target a DNA sequence by associating it with a specialized guide RNA (i.e., PEgRNA) containing a spacer sequence that anneals to a complementary protospacer in the target DNA. The specialized guide RNA also contains new genetic information in the form of an extension that encodes a replacement strand of DNA containing a desired genetic alteration which is used to to replace a corresponding endogenous DNA strand at the target site. To transfer information from the PEgRNA to the target DNA, the mechanism of prime editing involves nicking the target site in one strand of the DNA to expose a 3'-hydroxyl group. The exposed 3'-hydroxyl group can then be used to prime the DNA polymerization of the edit-encoding extension on PEgRNA directly into the target site. In various embodiments, the extension—which provides the template for polymerization of the replacement strand containing the edit—can be formed from RNA or DNA. In the case of an RNA extension, the polymerase of the prime editor can be an RNA-dependent DNA polymerase (such as, a reverse transcriptase). In the case of a DNA extension, the polymerase of the prime editor may be a DNA-dependent DNA polymerase.

The newly synthesized strand (i.e., the replacement DNA strand containing the desired edit) that is formed by the herein disclosed prime editors would be homologous to the genomic target sequence (i.e., have the same sequence as) except for the inclusion of a desired nucleotide change (e.g., a single nucleotide change, a deletion, or an insertion, or a combination thereof). The newly synthesized (or replacement) strand of DNA may also be referred to as a single strand DNA flap, which would compete for hybridization with the complementary homologous endogenous DNA strand, thereby displacing the corresponding endogenous strand. In certain embodiments, the system can be combined with the use of an error-prone reverse transcriptase enzyme (e.g., provided as a fusion protein with the Cas9 domain, or provided in trans to the Cas9 domain). The error-prone reverse transcriptase enzyme can introduce alterations during synthesis of the single strand DNA flap. Thus, in certain embodiments, error-prone reverse transcriptase can be utilized to introduce nucleotide changes to the target DNA. Depending on the error-prone reverse transcriptase that is used with the system, the changes can be random or non-random.

Resolution of the hybridized intermediate (comprising the single strand DNA flap synthesized by the reverse transcriptase hybridized to the endogenous DNA strand) can include removal of the resulting displaced flap of endogenous DNA (e.g., with a 5' end DNA flap endonuclease, FEN1), ligation of the synthesized single strand DNA flap to the target DNA, and assimilation of the desired nucleotide change as a result of cellular DNA repair and/or replication processes. Because templated DNA synthesis offers single nucleotide precision for the modification of any nucleotide, including insertions and deletions, the scope of this approach is very broad and could foreseeably be used for myriad applications in basic science and therapeutics.

In one aspect, the specification provides a fusion protein comprising a nucleic acid programmable DNA binding protein (napDNAbp) and a reverse transcriptase. In various embodiments, the fusion protein is capable of carrying out genome editing by target-primed reverse transcription in the presence of an extended guide RNA.

In certain embodiments, the napDNAbp has a nickase activity. The napDNAbp may also be a Cas9 protein or functional equivalent thereof, such as a nuclease active Cas9, a nuclease inactive Cas9 (dCas9), or a Cas9 nickase (nCas9).

In certain embodiments, the napDNAbp is selected from the group consisting of: Cas9, Cas12e, Cas12d, Cas12a, Cas12b1, Cas13a, Cas12c, and Argonaute and optionally has a nickase activity.

In other embodiments, the fusion protein when complexed with an extended guide RNA is capable of binding to a target DNA sequence.

In still other embodiments, the target DNA sequence comprises a target strand and a complementary non-target strand.

In other embodiments, the binding of the fusion protein complexed to the extended guide RNA forms an R-loop. The R-loop can comprise (i) an RNA-DNA hybrid comprising the extended guide RNA and the target strand, and (ii) the complementary non-target strand.

In still other embodiments, the complementary non-target strand is nicked to form a reverse transcriptase priming sequence having a free 3' end.

In various embodiments, the extended guide RNA comprises (a) a guide RNA and (b) an RNA extension at the 5' or the 3' end of the guide RNA, or at an intramolecular location in the guide RNA. The RNA extension can comprise (i) a reverse transcription template sequence comprising a desired nucleotide change, (ii) a reverse transcription primer binding site, and (iii) optionally, a linker sequence. In various embodiments, the reverse transcription template sequence may encode a single-strand DNA flap that is complementary to an endogenous DNA sequence adjacent to the nick site, wherein the single-strand DNA flap comprises the desired nucleotide change.

In various embodiments, the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

In still other embodiments, the single-strand DNA flap may hybridize to the endogenous DNA sequence adjacent to the nick site, thereby installing the desired nucleotide change. In still other embodiments, the single-stranded DNA flap displaces the endogenous DNA sequence adjacent to the nick site and which has a free 5' end. In certain embodiments, the displaced endogenous DNA having the 5' end is excised by the cell.

In various embodiments, the cellular repair of the single-strand DNA flap results in installation of the desired nucleotide change, thereby forming a desired product.

In various other embodiments, the desired nucleotide change is installed in an editing window that is between about −4 to +10 of the PAM sequence.

In still other embodiments, the desired nucleotide change is installed in an editing window that is between about −5 to +5 of the nick site, or between about −10 to +10 of the nick site, or between about −20 to +20 of the nick site, or between about −30 to +30 of the nick site, or between about −40 to +40 of the nick site, or between about −50 to +50 of the nick site, or between about −60 to +60 of the nick site, or between about −70 to +70 of the nick site, or between about −80 to +80 of the nick site, or between about −90 to +90 of the nick site, or between about −100 to +100 of the nick site, or between about −200 to +200 of the nick site.

In various embodiments, the napDNAbp comprises an amino acid sequence of SEQ ID NO: 18. In various other embodiments, the napDNAbp comprises an amino acid sequence that is at least 80%, 85%, 90%, 95%, 98%, or 99% identical to the amino acid sequence of any one of SEQ ID NOs: 26-39, 42-61, 75-76, 126, 130, 137, 141, 147, 153, 157, 445, 460, 467, and 482-487 (Cas9); (SpCas9); SEQ ID NO: 77-86 (CP-Cas9); SEQ ID NO: 18-25 and 87-88 (SpCas9); and SEQ ID NOs: 62-72 (Cas12)

In other embodiments, the reverse transcriptase of the disclosed fusion proteins and/or compositions may comprise any one of the amino acid sequences of SEQ ID NOs: 89-100, 105-122, 128-129, 132, 139, 143, 149, 154, 159, 235, 454, 471, 516, 662, 700-716, 739-742, and 766. In still other embodiments, the reverse transcriptase may comprise an amino acid sequence that is at least 80%, 85%, 90%, 95%, 98%, or 99% identical to the amino acid sequence of any one of SEQ ID NOs: 89-100, 105-122, 128-129, 132, 139, 143, 149, 154, 159, 235, 454, 471, 516, 662, 700-716, 739-742, and 766. These sequences may be naturally occurring reverse transcriptase sequences, e.g., from a retrovirus or a retrotransposon, of the sequences may be recombinant.

In various other embodiments, the fusion proteins herein disclosed may comprise various structural configurations. For example, the fusion proteins may comprise the structure NH$_2$-[napDNAbp]-[reverse transcriptase]-COOH; or NH$_2$-[reverse transcriptase]-[napDNAbp]-COOH, wherein each instance of "]-[" indicates the presence of an optional linker sequence.

In various embodiments, the linker sequence comprises an amino acid sequence of SEQ ID NOs: 127, 165-176, 446, 453, and 767-769, or an amino acid sequence that this at least 80%, 85%, or 90%, or 95%, or 99% identical to any one of the linker amino acid sequence of SEQ ID NOs: 127, 165-176, 446, 453, and 767-769.

In various embodiments, the desired nucleotide change that is incorporated into the target DNA can be a single nucleotide change (e.g., a transition or transversion), an insertion of one or more nucleotides, or a deletion of one or more nucleotides.

In certain cases, the insertion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, or at least 500 nucleotides in length.

In certain other cases, the deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, or at least 500 nucleotides in length.

In another aspect, the present disclosure provides an extended guide RNA comprising a guide RNA and at least one RNA extension. The RNA extension can be positioned at the 3' end of the guide RNA. In other embodiments, the RNA extension can be positioned at the 5' of the guide RNA. In still other embodiments, the RNA extension can be positioned at an intramolecular position within the guide RNA, however, preferable, the intramolecular positioning of the extended portion does not disrupt the functioning of the protospacer.

In various embodiments, the extended guide RNA is capable of binding to a napDNAbp and directing the napDNAbp to a target DNA sequence. The target DNA sequence can comprise a target strand and a complementary non-target strand, wherein the guide RNA hybridizes to the target strand to form an RNA-DNA hybrid and an R-loop.

In various embodiments of the extended guide RNA, the at least one RNA extension can comprise a reverse transcription template sequence. In various other embodiment, the RNA extension may further comprises a reverse transcription primer binding site. In still further embodiments, the RNA extension may comprise a linker or spacer sequence that joins the RNA extension to the guide RNA.

In various embodiments, the RNA extension can be at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 150 nucleotides, at least 200 nucleotides, at least 300 nucleotides, at least 400 nucleotides, or at least 500 nucleotides in length.

In other embodiments, the reverse transcription template sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

In still other embodiments, wherein the reverse transcription primer binding site sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

In other embodiments, the optional linker or spacer sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

In various embodiments of the extended guide RNAs, the reverse transcription template sequence may encode a single-strand DNA flap that is complementary to an endogenous DNA sequence adjacent to a nick site, wherein the single-strand DNA flap comprises a desired nucleotide change. The single-stranded DNA flap may displace an endogenous single-strand DNA at the nick site. The displaced endogenous single-strand DNA at the nick site can have a 5' end and form an endogenous flap, which can be excised by the cell. In various embodiments, excision of the 5' end endogenous flap can help drive product formation since removing the 5' end endogenous flap encourages hybridization of the single-strand 3' DNA flap to the corresponding complementary DNA strand, and the incorporation or assimilation of the desired nucleotide change carried by the single-strand 3' DNA flap into the target DNA.

In various embodiments of the extended guide RNAs, the cellular repair of the single-strand DNA flap results in installation of the desired nucleotide change, thereby forming a desired product.

In certain embodiments, the PEgRNA comprises the nucleotide sequence of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, and 3972-3989, or a nucleotide sequence having at least 85%, or at least 90%, or at least 95%, or at least 98%, or at least 99% sequence identity with any one of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, and 3972-3989.

In yet another aspect of the invention, the specification provides for complexes comprising a fusion protein described herein and any extended guide RNA described above.

In still other aspects of the invention, the specification provides a complex comprising a napDNAbp and an extended guide RNA. The napDNAbp can be a Cas9 nickase, or can be an amino acid sequence of SEQ ID NOs: 42-57 (Cas9 nickase) and 65 (AsCas12a nickase), or an amino acid sequence that is at least 80%, 85%, 90%, 95%, 98%, or 99% identical to the amino acid sequence of any one of SEQ ID NOs: 42-57 (Cas9 nickase) and 65 (AsCas12a nickase).

In various embodiments involving a complex, the extended guide RNA is capable of directing the napDNAbp to a target DNA sequence. In various embodiments, a reverse transcriptase may be provided in trans, i.e., provided from a different source than the complex itself. For example, a reverse transcriptase could be provided to the same cell having the complex by introducing a separate vector separately encoding the reverse transcriptase.

In yet another aspect, the specification provides polynucleotides. In certain embodiments, the polynucleotides may encode any of the fusion proteins disclosed herein. In certain other embodiments, the polynucleotides may encode any of the napDNAbps disclosed herein. In still further embodiments, the polynucleotides may encode any of the reverse transcriptases disclosed herein. In yet other embodiments, the polynucleotides may encode any of the extended guide RNAs disclosed herein, any of the reverse transcription template sequences, or any of the reverse transcription primer sites, or any of the optional linker sequences.

In still other aspects, the specification provides vectors comprising the polynucleotides described herein. Thus, in certain embodiments, the vectors comprise polynucleotides for encoding the fusion proteins comprising a napDNAbp and a reverse transcriptase. In other embodiments, the vectors comprise polynucleotides that separately encode a napDNAbp and reverse transcriptase. In still other embodiments, the vectors may comprise polynucleotides that encode the extended guide RNAs. In various embodiments, the vectors may comprise one or more polynucleotides that encode napDNAbps, reverse transcriptase, and extended guide RNAs on the same or separate vectors.

In still other aspects, the specification provides cells comprising a fusion protein as described herein and an extended guide RNA. The cells may be transformed with the vectors comprising the fusion proteins, napDNAbps, reverse transcriptase, and extended guide RNAs. These genetic elements may be comprised on the same vectors or on different vectors.

In yet another aspect, the specification provides pharmaceutical compositions. In certain embodiments, the pharmaceutical compositions comprise one or more of a napDNAbp, a fusion protein, a reverse transcriptase, and an extended guide RNA. In certain embodiments, the fusion protein described herein and a pharmaceutically acceptable excipient. In other embodiments, the pharmaceutical compositions comprise any extend guide RNA described herein and a pharmaceutically acceptable excipient. In still other embodiments, the pharmaceutical compositions comprise any extend guide RNA described herein in combination with any fusion protein described herein and a pharmaceutically acceptable excipient. In yet other embodiments, the pharmaceutical compositions comprise any polynucleotide sequence encoding one or more of a napDNAbp, a fusion protein, a reverse transcriptase, and an extended guide RNA. In still other embodiments, the various components disclosed herein may be separated into one or more pharmaceutical compositions. For example, a first pharmaceutical composition may comprise a fusion protein or a napDNAbp, a second pharmaceutical compositions may comprise a reverse transcriptase, and a third pharmaceutical composition may comprise an extended guide RNA.

In still a further aspect, the present disclosure provides kits. In one embodiment, the kit comprises one or more polynucleotides encoding one or more components, including a fusion protein, a napDNAbp, a reverse transcriptase, and an extended guide RNA. The kits may also comprise vectors, cells, and isolated preparations of polypeptides, including any fusion protein, napDNAbp, or reverse transcriptase disclosed herein.

In yet another aspect, the present disclosure provides for methods of using the disclosed compositions of matter.

In one embodiment, the methods relate to a method for installing a desired nucleotide change in a double-stranded DNA sequence. The method first comprises contacting the double-stranded DNA sequence with a complex comprising a fusion protein and an extended guide RNA, wherein the fusion protein comprises a napDNAbp and a reverse transcriptase and wherein the extended guide RNA comprises a reverse transcription template sequence comprising the desired nucleotide change. Next, the method involves nicking the double-stranded DNA sequence on the non-target strand, thereby generating a free single-strand DNA having a 3' end. The method then involves hybridizing the 3' end of the free single-strand DNA to the reverse transcription template sequence, thereby priming the reverse transcriptase domain. The method then involves polymerizing a strand of DNA from the 3' end, thereby generating a single-strand DNA flap comprising the desired nucleotide change. Then, the method involves replacing an endogenous DNA strand adjacent the cut site with the single-strand DNA flap, thereby installing the desired nucleotide change in the double-stranded DNA sequence.

In other embodiments, the disclosure provides for a method for introducing one or more changes in the nucleotide sequence of a DNA molecule at a target locus, comprising contacting the DNA molecule with a nucleic acid programmable DNA binding protein (napDNAbp) and a guide RNA which targets the napDNAbp to the target locus, wherein the guide RNA comprises a reverse transcriptase (RT) template sequence comprising at least one desired nucleotide change. Next, the method involves forming an exposed 3' end in a DNA strand at the target locus and then hybridizing the exposed 3' end to the RT template sequence to prime reverse transcription. Next, a single strand DNA flap comprising the at least one desired nucleotide change based on the RT template sequence is synthesized or polymerized by reverse transcriptase. Lastly, the at least one desired nucleotide change is incorporated into the corresponding endogenous DNA, thereby introducing one or more changes in the nucleotide sequence of the DNA molecule at the target locus.

In still other embodiments, the disclosure provides a method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change; (b) conducting target-primed reverse transcription of the RT template to generate a single strand DNA comprising the desired nucleotide change; and (c) incorporating the desired nucleotide change into the DNA molecule at the target locus through a DNA repair and/or replication process.

In certain embodiments, the step of replacing the endogenous DNA strand comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

In various embodiments, the desired nucleotide change can be a single nucleotide substitution (e.g., and transition or a transversion change), a deletion, or an insertion. For example, the desired nucleotide change can be (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

In other embodiments, the desired nucleoid change can convert (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

In still other embodiments, the method introduces a desired nucleotide change that is an insertion. In certain cases, the insertion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, or at least 500 nucleotides in length.

In other embodiments, the method introduces a desired nucleotide change that is a deletion. In certain other cases, the deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, or at least 500 nucleotides in length.

In various embodiments, the desired nucleotide change corrects a disease-associated gene. The disease-associated gene can be associated with a monogenetic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease. In other embodiments, the disease-associated gene can be associated with a polygenic disorder selected from the group consisting of: heart disease; high blood pressure; Alzheimer's disease; arthritis; diabetes; cancer; and obesity.

The methods disclosed herein may involve fusion proteins having a napDNAbp that is a nuclease dead Cas9 (dCas9), a Cas9 nickase (nCas9), or a nuclease active Cas9. In other embodiments, a napDNAbp and reverse transcriptase are not encoded as a single fusion protein, but rather can be provided in separate constructs. Thus, in some embodiments, the reverse transcriptase can be provided in trans relative to the napDNAbp (rather than by way of a fusion protein).

In various embodiments involving methods, the napDNAbp may comprise an amino acid sequence of SEQ ID NOs: 26-61, 75-76, 126, 130, 137, 141, 147, 153, 157, 445, 460, 467, and 482-487 (Cas9); (SpCas9); SEQ ID NO: 77-86 (CP-Cas9); SEQ ID NO: 18-25 and 87-88 (SpCas9); and SEQ ID NOs: 62-72 (Cas12). The napDNAbp may also comprise an amino acid sequence that is at least 80%, 85%, 90%, 95%, 98%, or 99% identical to the amino acid sequence of any one of SEQ ID NOs: 26-61, 75-76, 126, 130, 137, 141, 147, 153, 157, 445, 460, 467, and 482-487 (Cas9); (SpCas9); SEQ ID NO: 77-86 (CP-Cas9); SEQ ID NO: 18-25 and 87-88 (SpCas9); and SEQ ID NOs: 62-72 (Cas12).

In various embodiments involving methods, the reverse transcriptase may comprise any one of the amino acid sequences of SEQ ID NOs: 89-100, 105-122, 128-129, 132, 139, 143, 149, 154, 159, 235, 454, 471, 516, 662, 700-716, 739-742, and 766. The reverse transcriptase may also comprise an amino acid sequence that is at least 80%, 85%, 90%, 95%, 98%, or 99% identical to the amino acid sequence of any one of SEQ ID NOs: 89-100, 105-122, 128-129, 132, 139, 143, 149, 154, 159, 235, 454, 471, 516, 662, 700-716, 739-742, and 766.

The methods may involve the use of a PEgRNA comprising a nucleotide sequence of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, and 3972-3989, or a nucleotide sequence having at least 80%, or at least 85%, or at least 90%, or at least 95%, or at least 99% sequence identity thereto The methods may comprise the use of extended guide RNAs that comprise an RNA extension at the 3' end, wherein the RNA extension comprises the reverse transcription template sequence.

The methods may comprise the use of extended guide RNAs that comprise an RNA extension at the 5' end, wherein the RNA extension comprises the reverse transcription template sequence.

The methods may comprise the use of extended guide RNAs that comprise an RNA extension at an intramolecular location in the guide RNA, wherein the RNA extension comprises the reverse transcription template sequence.

The methods may comprise the use of extended guide RNAs having one or more RNA extensions that are at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, or at least 500 nucleotides in length.

It should be appreciated that the foregoing concepts, and additional concepts discussed below, may be arranged in any suitable combination, as the present disclosure is not limited in this respect. Further, other advantages and novel features of the present disclosure will become apparent from the following detailed description of various non-limiting embodiments when considered in conjunction with the accompanying figures.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein.

FIG. 1I is a schematic depicting temporal second strand nicking exemplified by PE3b (PE3b=PE2 prime editor fusion protein+PEgRNA+second strand nicking guide RNA). Temporal second strand nicking is a variant of second strand nicking in order to facilitate the formation of the desired edited product. The "temporal" term refers to the fact that the second-strand nick to the unedited strand occurs only after the desired edit is installed in the edited strand. This avoids concurrent nicks on both strands to lead to double-stranded DNA breaks.

FIGS. 1J-1K depict a variation of prime editing contemplated herein that replaces the napDNAbp (e.g., SpCas9 nickase) with any programmable nuclease domain, such as zinc finger nucleases (ZFN) or transcription activator-like effector nucleases (TALEN). As such, it is contemplated that suitable nucleases do not necessarily need to be "programmed" by a nucleic acid targeting molecule (such as a guide RNA), but rather, may be programmed by defining the specificity of a DNA-binding domain, such as and in particular, a nuclease. Just as in prime editing with napDNAbp moieties, it is preferable that such alternative programmable nucleases be modified such that only one strand of a target DNA is cut. In other words, the programmable nucleases should function as nickases, preferably. Once a programmable nuclease is selected (e.g., a ZFN or a TALEN), then additional functionalities may be engineered into the system to allow it to operate in accordance with a prime editing-like mechanism. For example, the programmable nucleases may be modified by coupling (e.g., via a chemical linker) an RNA or DNA extension arm thereto, wherein the extension arm comprises a primer binding site (PBS) and a DNA synthesis template. The programmable nuclease may also be coupled (e.g., via a chemical or amino acid linker) to a polymerase, the nature of which will depend upon whether the extension arm is DNA or RNA. In the case of an RNA extension arm, the polymerase can be an RNA-dependent DNA polymerase (e.g., reverse transcriptase). In the case of a DNA extension arm, the polymerase can be a DNA-dependent DNA polymerase (e.g., a prokaryotic polymerase, including Pol I, Pol II, or Pol III, or a eukaryotic polymerase, including Pol a, Pol b, Pol g, Pol d, Pol e, or Pol z). The system may also include other functionalities added as fusions to the programmable nucleases, or added in trans to facilitate the reaction as a whole (e.g., (a) a helicase to unwind the DNA at the cut site to make the cut strand with the 3' end available as a primer, (b) a flap endonuclease (e.g., FEN1) to help remove the endogenous strand on the cut strand to drive the reaction towards replacement of the endogenous strand with the synthesized strand, or (c) a nCas9:gRNA complex to create a second site nick on the opposite strand, which may help drive the integration of the synthesize repair through favored cellular repair of the non-edited strand). In an analogous manner to prime editing with a napDNAbp, such a complex with an otherwise programmable nuclease could be used to synthesize and then install a newly synthesized replacement strand of DNA carrying an edit of interest permanently into a target site of DNA.

FIG. 2 shows three Cas complexes (SpCas9, SaCas9, and LbCas12a) that can be used in the herein described prime editors and their PAM, gRNA, and DNA cleavage features. The figure shows designs for complexes involving SpCas9, SaCas9, and LbCas12a.

" FIG. 3D and FIG. 3E provide additional embodiments of 3' and 5' prime editor gRNAs (PEgRNAs), respectively. FIG. 3F illustrates the interaction between a 3' end prime editor guide RNA with a target DNA sequence. The embodiments of FIGS. 3A-3C depict exemplary arrangements of the reverse transcription template sequence (i.e., or more broadly referred to as a DNA synthesis template, as indicated, since the RT is only one type of polymerase that may be used in the context of prime editors), the primer binding site, and an optional linker sequence in the extended portions of the 3', 5', and intramolecular versions, as well as the general arrangements of the spacer and core regions. The disclosed prime editing process is not limited to these configurations of extended guide RNAs. The embodiment of FIG. 3D provides the structure of an exemplary PEgRNA contemplated herein. The PEgRNA comprises three main component elements ordered in the 5' to 3' direction, namely: a spacer, a gRNA core, and an extension arm at the 3' end. The extension arm may further be divided into the following structural elements in the 5' to 3' direction, namely: a primer binding site (A), an edit template (B), and a homology arm (C). In addition, the PEgRNA may comprise an optional 3' end modifier region (e1) and an optional 5' end modifier region (e2). Still further, the PEgRNA may comprise a transcriptional termination signal at the 3' end of the PEgRNA (not depicted). These structural elements are further defined herein. The depiction of the structure of the PEgRNA is not meant to be limiting and embraces variations in the arrangement of the elements. For example, the optional sequence modifiers (e1) and (e2) could be positioned within or between any of the other regions shown, and not limited to being located at the 3' and 5' ends. The PEgRNA could comprise, in certain embodiments, secondary RNA structure, such as, but not limited to, hairpins, stem/loops, toe loops, RNA-binding protein recruitment domains (e.g., the MS2 aptamer which recruits and binds to the MS2cp protein). For instance, such secondary structures could be position within the spacer, the gRNA core, or the extension arm, and in particular, within the e1 and/or e2 modifier regions. In addition to secondary RNA structures, the PEgRNAs could comprise (e.g., within the e1 and/or e2 modifier regions) a chemical linker or a poly(N) linker or tail, where "N" can be any nucleobase. In some embodiments (e.g., as shown in FIG. 72(c)), the chemical linker may function to prevent reverse transcription of the sgRNA scaffold or core. In addition, in certain embodiments (e.g., see FIG. 72(c)), the extension arm (3) could be comprised of RNA or DNA, and/or could include one or more nucleobase analogs (e.g., which might add functionality, such as temperature resilience). Still further, the orientation of the extension arm (3) can be in the natural 5'-to-3' direction, or synthesized in the opposite orientation in the 3'-to-5' direction (relative to the orientation of the PEgRNA molecule overall). It is also noted that one of ordinary skill in the art will be able to select an appropriate DNA polymerase, depending on the nature of the nucleic acid materials of the extension arm (i.e., DNA or RNA), for use in prime editing that may be implemented either as a fusion with the napDNAbp or as provided in trans as a separate moiety to synthesize the desired template-encoded 3' single-strand DNA flap that includes the desired edit. For example, if the extension arm is RNA, then the DNA polymerase could be a reverse transcriptase or any other suitable RNA-dependent DNA polymerase. However, if the extension arm is DNA, then the DNA polymerase could be a DNA-dependent DNA polymerase. In various embodiments, provision of the DNA polymerase could be in trans, e.g., through the use of an RNA-protein recruitment domain (e.g., an MS2 hairpin installed on the PEgRNA (e.g., in the e1 or e2 region, or elsewhere and an MS2cp protein fused to the DNA polymerase, thereby co-localizing the DNA polymerase to the PEgRNA). It is also noted that the primer binding site does not generally form a part of the template that is used by the DNA polymerase (e.g., reverse transcriptase) to encode the resulting 3' single-strand DNA flap that includes the desired edit. Thus, the designation of the "DNA synthesis template" refers to the region or portion of the extension arm (3) that is used as a template by the DNA polymerase to encode the desired 3' single-strand DNA flap containing the edit and regions of homology to the 5' endogenous single strand DNA flap that is replaced by the 3' single strand DNA strand product of prime editing DNA synthesis. In some embodiments, the DNA synthesis template includes the "edit template" and the "homology arm", or one or more homology arms, e.g., before and after the edit template. The edit template can be as small as a single nucleotide substitution, or it may be an insertion, or an inversion of DNA. In addition, the edit template may also include a deletion, which can be engineered by encoding homology arm that contains a desired deletion. In other embodiments, the DNA synthesis template may also include the e2 region or a portion thereof. For instance, if the e2 region comprises a secondary structure that causes termination of DNA polymerase activity, then it is possible that DNA polymerase function will be terminated before any portion of the e2 region is actual encoded into DNA. It is also possible that some or even all of the e2 region will be encoded into DNA. How much of e2 is actually used as a template will depend on its constitution and whether that constitution interrupts DNA polymerase function.

Figure 3A:
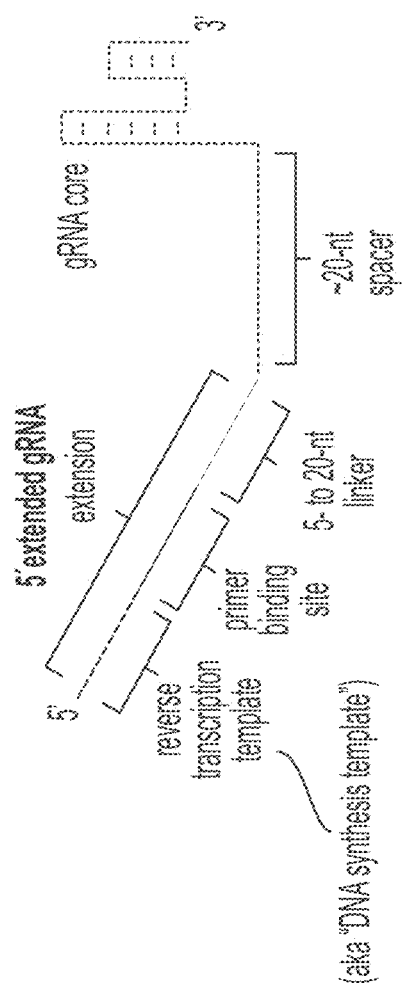
FIGS. 3A-3F show designs for engineered 5' prime editor gRNA (FIG. 3A), 3' prime editor gRNA (FIG. 3B), and an intramolecular extension (FIG. 3C). The extended guide RNA (or extended gRNA) may also be referred to herein as PEgRNA or "prime editing guide RNA.
Figure 3C:
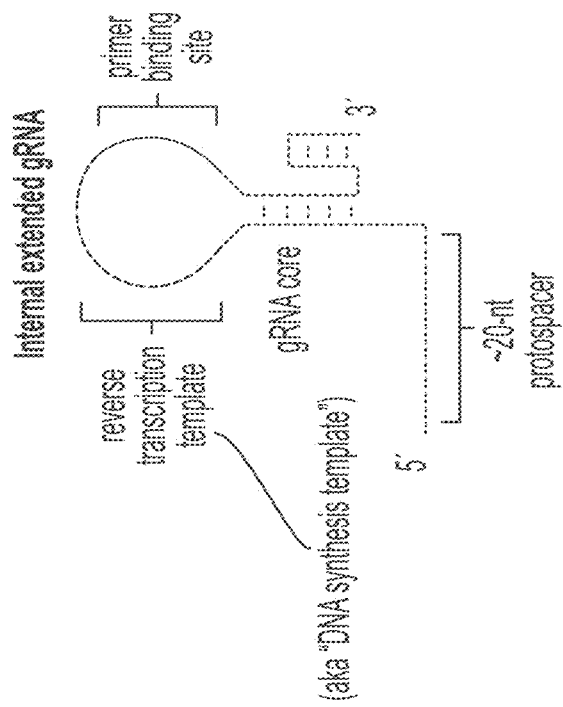
Figure 3B:
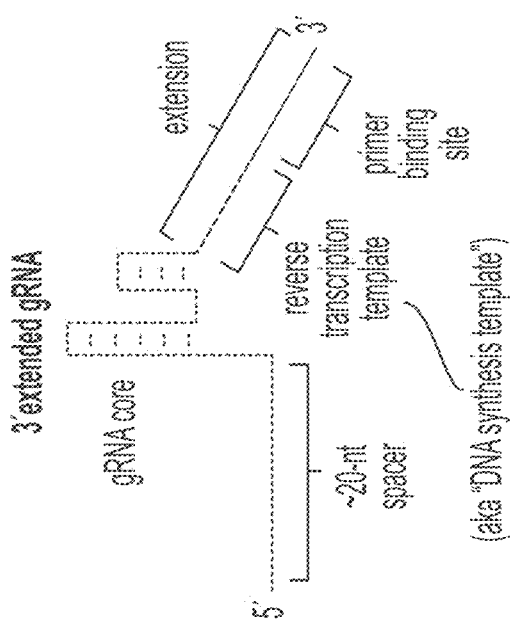
Figure 3D:
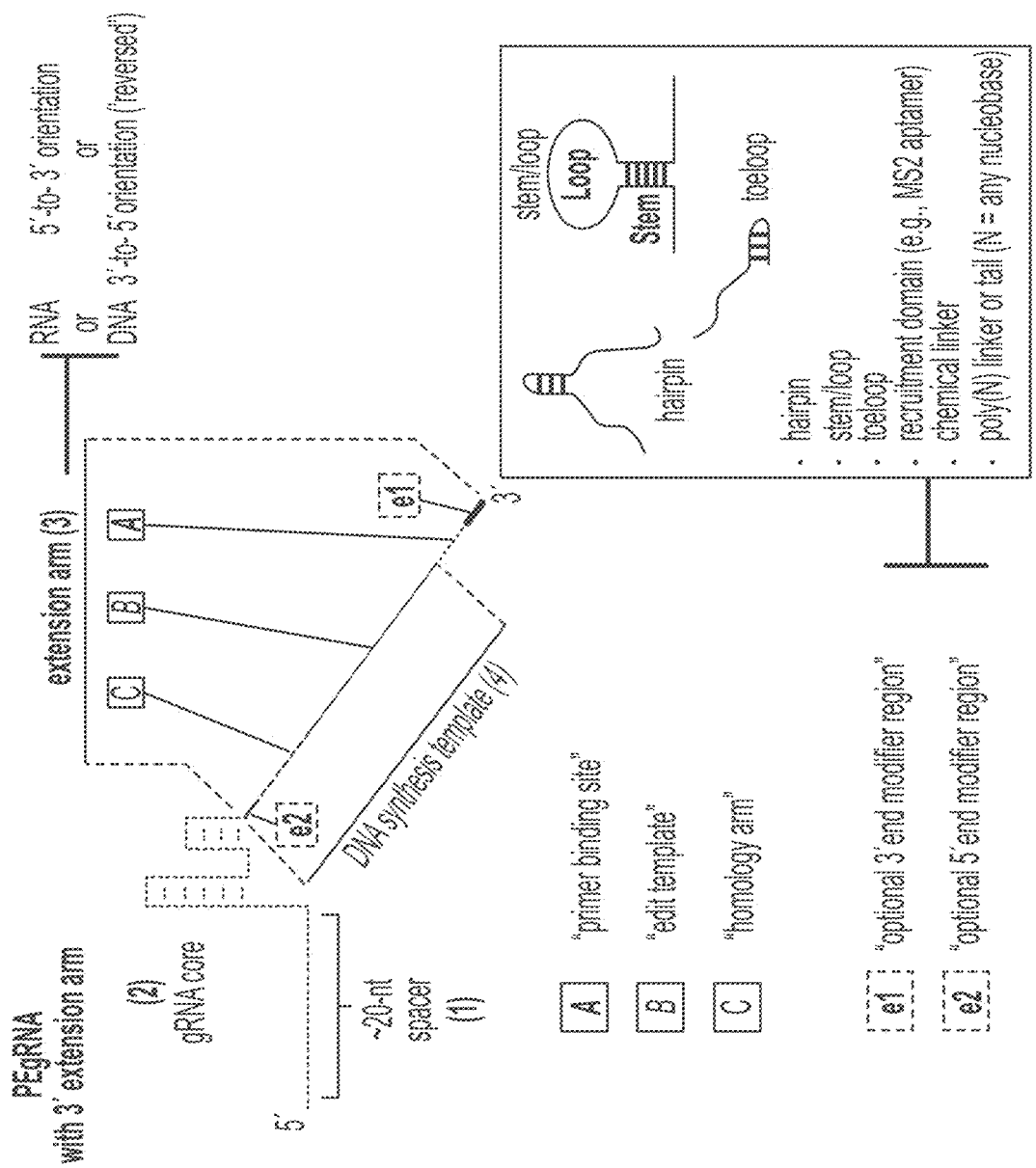
Figure 3E:
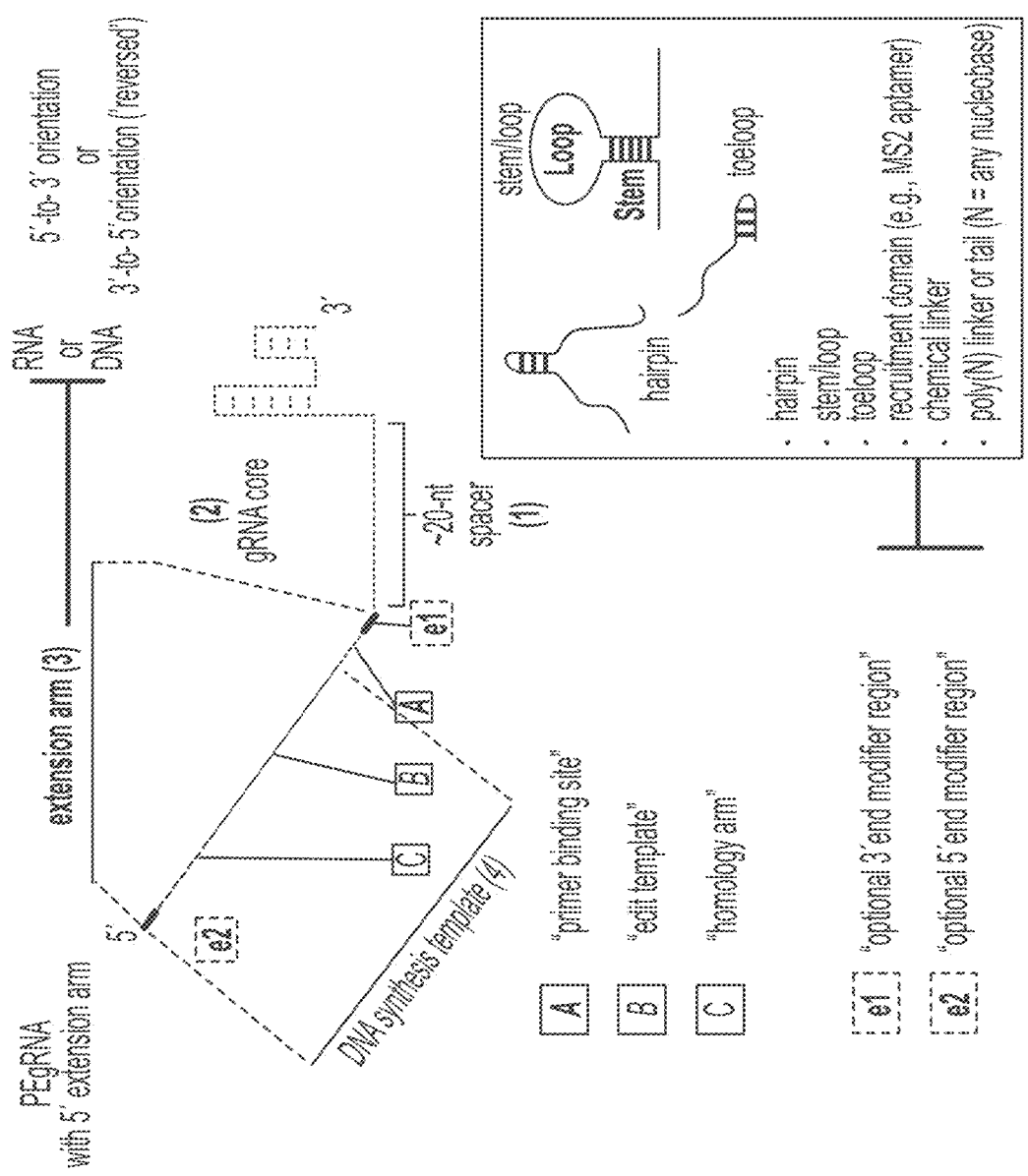

The embodiment of FIG. 3E provides the structure of another PEgRNA contemplated herein. The PEgRNA comprises three main component elements ordered in the 5' to 3' direction, namely: a spacer, a gRNA core, and an extension arm at the 3' end. The extension arm may further be divided into the following structural elements in the 5' to 3' direction, namely: a primer binding site (A), an edit template (B), and a homology arm (C). In addition, the PEgRNA may comprise an optional 3' end modifier region (e1) and an optional 5' end modifier region (e2). Still further, the PEgRNA may comprise a transcriptional termination signal on the 3' end of the PEgRNA (not depicted). These structural elements are further defined herein. The depiction of the structure of the PEgRNA is not meant to be limiting and embraces variations in the arrangement of the elements. For example, the optional sequence modifiers (e1) and (e2) could be positioned within or between any of the other regions shown, and not limited to being located at the 3' and 5' ends. The PEgRNA could comprise, in certain embodiments, secondary RNA structures, such as, but not limited to, hairpins, stem/loops, toe loops, RNA-binding protein recruitment domains (e.g., the MS2 aptamer which recruits and binds to the MS2cp protein). These secondary structures could be positioned anywhere in the PEgRNA molecule. For instance, such secondary structures could be position within the spacer, the gRNA core, or the extension arm, and in particular, within the e1 and/or e2 modifier regions. In addition to secondary RNA structures, the PEgRNAs could comprise (e.g., within the e1 and/or e2 modifier regions) a chemical linker or a poly(N) linker or tail, where "N" can be any nucleobase. In some embodiments (e.g., as shown in FIG. 72(c)), the chemical linker may function to prevent reverse transcription of the sgRNA scaffold or core. In addition, in certain embodiments (e.g., see FIG. 72(c)), the extension arm (3) could be comprised of RNA or DNA, and/or could include one or more nucleobase analogs (e.g., which might add functionality, such as temperature resilience). Still further, the orientation of the extension arm (3) can be in the natural 5'-to-3' direction, or synthesized in the opposite orientation in the 3'-to-5' direction (relative to the orientation of the PEgRNA molecule overall). It is also noted that one of ordinary skill in the art will be able to select an appropriate DNA polymerase, depending on the nature of the nucleic acid materials of the extension arm (i.e., DNA or RNA), for use in prime editing that may be implemented either as a fusion with the napDNAbp or as provided in trans as a separate moiety to synthesize the desired template-encoded 3' single-strand DNA flap that includes the desired edit. For example, if the extension arm is RNA, then the DNA polymerase could be a reverse transcriptase or any other suitable RNA-dependent DNA polymerase. However, if the extension arm is DNA, then the DNA polymerase could be a DNA-dependent DNA polymerase. In various embodiments, provision of the DNA polymerase could be in trans, e.g., through the use of an RNA-protein recruitment domain (e.g., an MS2 hairpin installed on the PEgRNA (e.g., in the e1 or e2 region, or elsewhere and an MS2cp protein fused to the DNA polymerase, thereby co-localizing the DNA polymerase to the PEgRNA). It is also noted that the primer binding site does not generally form a part of the template that is used by the DNA polymerase (e.g., reverse transcriptase) to encode the resulting 3' single-strand DNA flap that includes the desired edit. Thus, the designation of the "DNA synthesis template" refers to the region or portion of the extension arm (3) that is used as a template by the DNA polymerase to encode the desired 3' single-strand DNA flap containing the edit and regions of homology to the 5' endogenous single strand DNA flap that is replaced by the 3' single strand DNA strand product of prime editing DNA synthesis. In some embodiments, the DNA synthesis template includes the "edit template" and the "homology arm", or one or more homology arms, e.g., before and after the edit template. The edit template can be as small as a single nucleotide substitution, or it may be an insertion, or an inversion of DNA. In addition, the edit template may also include a deletion, which can be engineered by encoding homology arm that contains a desired deletion. In other embodiments, the DNA synthesis template may also include the e2 region or a portion thereof. For instance, if the e2 region comprises a secondary structure that causes termination of DNA polymerase activity, then it is possible that DNA polymerase function will be terminated before any portion of the e2 region is actual encoded into DNA. It is also possible that some or even all of the e2 region will be encoded into DNA. How much of e2 is actually used as a template will depend on its constitution and whether that constitution interrupts DNA polymerase function.

Figure 1A:
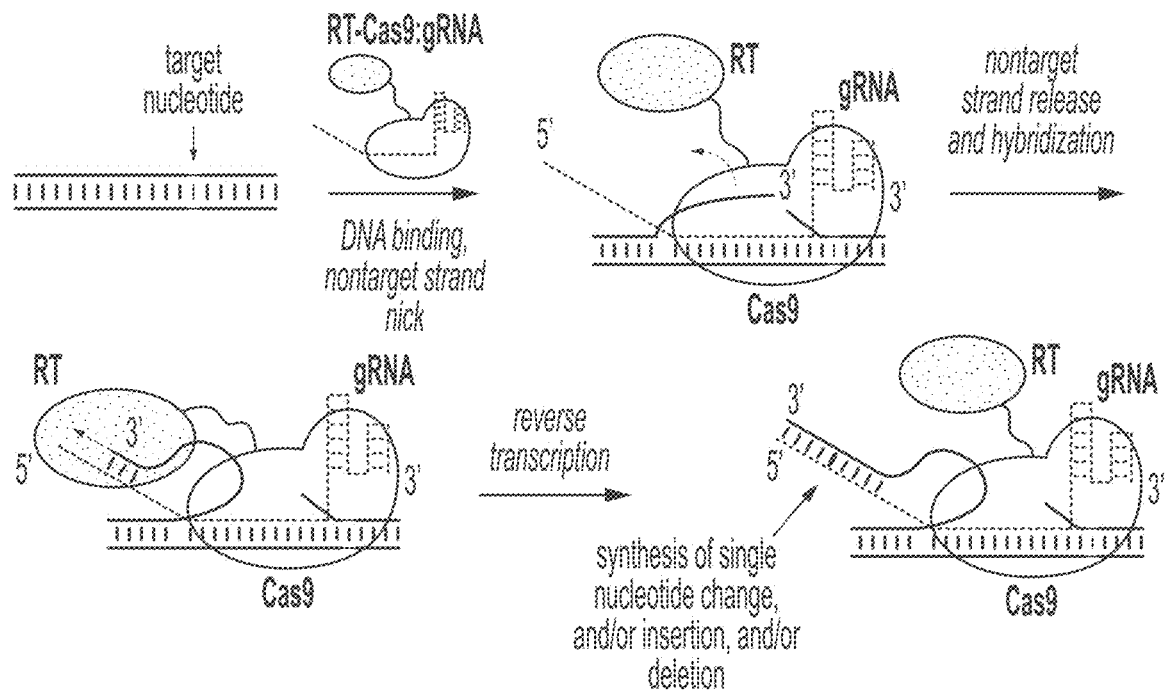
FIG. 1A provides a schematic of an exemplary process for introducing a single nucleotide change, and/or insertion, and/or deletion into a DNA molecule (e.g., a genome) using a fusion protein comprising a reverse transcriptase fused to a Cas9 protein in complex with an extended guide RNA molecule. In this embodiment, the guide RNA is extended at the 3' end to include a reverse transcriptase template sequence. The schematic shows how a reverse transcriptase (RT) fused to a Cas9 nickase, in a complex with a guide RNA (gRNA), binds the DNA target site and nicks the PAM-containing DNA strand adjacent to the target nucleotide. The RT enzyme uses the nicked DNA as a primer for DNA synthesis from the gRNA, which is used as a template for the synthesis of a new DNA strand that encodes the desired edit. The editing process shown may be referred to as target-primed reverse transcription editing (TRT editing) or equivalently, "prime editing."
Figure 1B:
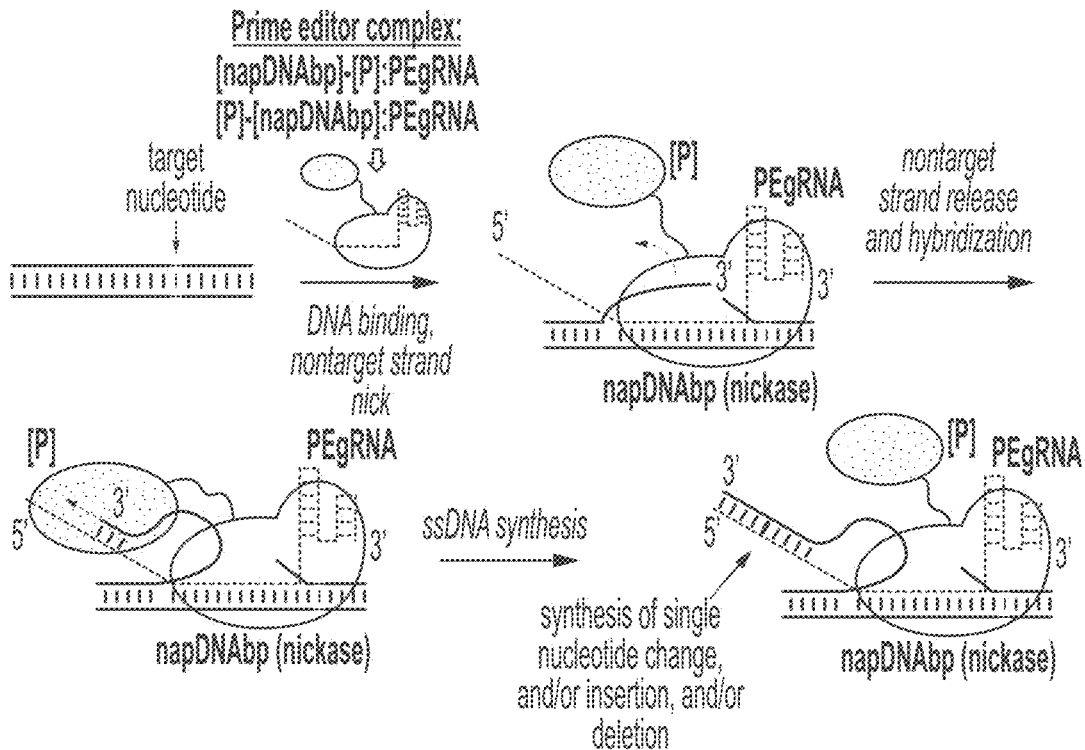
FIG. 1B provides the same representation as in FIG. 1A, except that the prime editor complex is represented more generally as [napDNAbp]-[P]:PEgRNA or [P]-[napDNAbp]:PEgRNA, wherein "P" refers to any polymerase (e.g., a reverse transcriptase), "napDNAbp" refers to a nucleic acid programmable DNA binding protein (e.g., SpCas9), and "PEgRNA" refers to a prime editing guide RNA, and "]-[" refers to an optional linker. As described elsewhere, e.g., FIGS. 3A-3G, the PEgRNA comprises an 5' extension arm comprising a primer binding site and a DNA synthesis template. Although not shown, it is contemplated that the extension arm of the PEgRNA (i.e., which comprises a primer binding site and a DNA synthesis template) can be DNA or RNA. The particular polymerase contemplated in this configuration will depend upon the nature of the DNA synthesis template. For instance, if the DNA synthesis template is RNA, then the polymerase case be an RNA-dependent DNA polymerase (e.g., reverse transcriptase). If the DNA synthesis template is DNA, then the polymerase can be a DNA-dependent DNA polymerase.
Figure 1C:
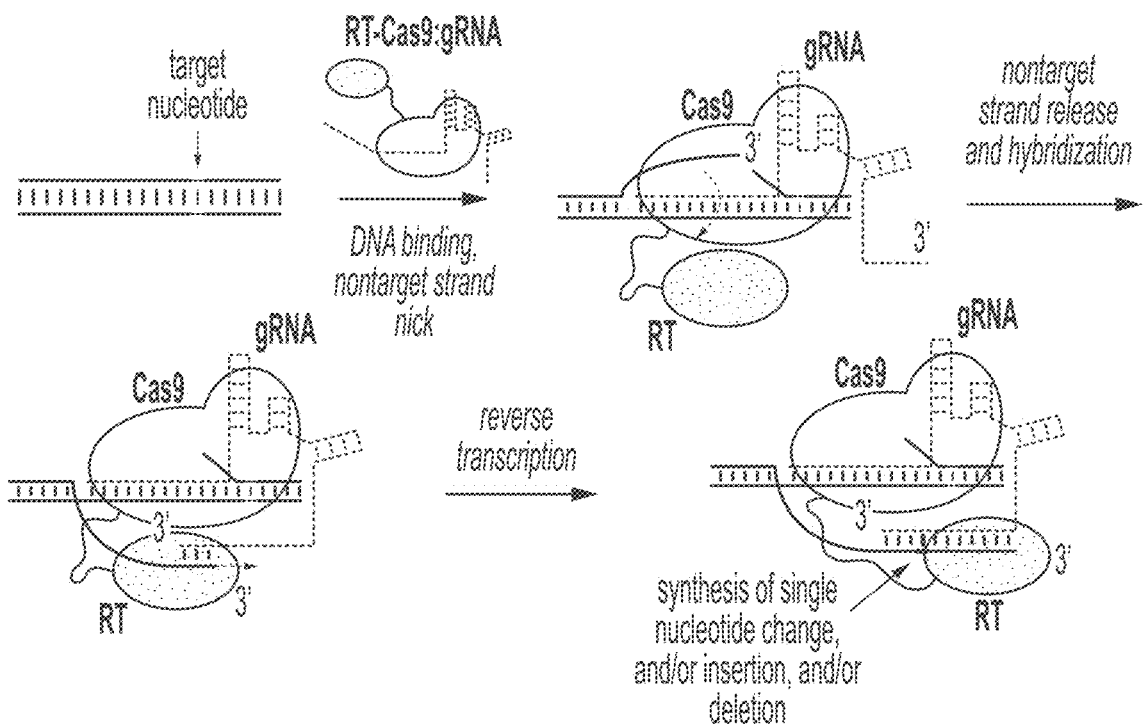
FIG. 1C provides a schematic of an exemplary process for introducing a single nucleotide change, and/or insertion, and/or deletion into a DNA molecule (e.g., a genome) using a fusion protein comprising a reverse transcriptase fused to a Cas9 protein in complex with an extended guide RNA molecule. In this embodiment, the guide RNA is extended at the 5' end to include a reverse transcriptase template sequence. The schematic shows how a reverse transcriptase (RT) fused to a Cas9 nickase, in a complex with a guide RNA (gRNA), binds the DNA target site and nicks the PAM-containing DNA strand adjacent to the target nucleotide. The RT enzyme uses the nicked DNA as a primer for DNA synthesis from the gRNA, which is used as a template for the synthesis of a new DNA strand that encodes the desired edit. The editing process shown may be referred to as target-primed reverse transcription editing (TRT editing) or equivalently, "prime editing."
Figure 1D:
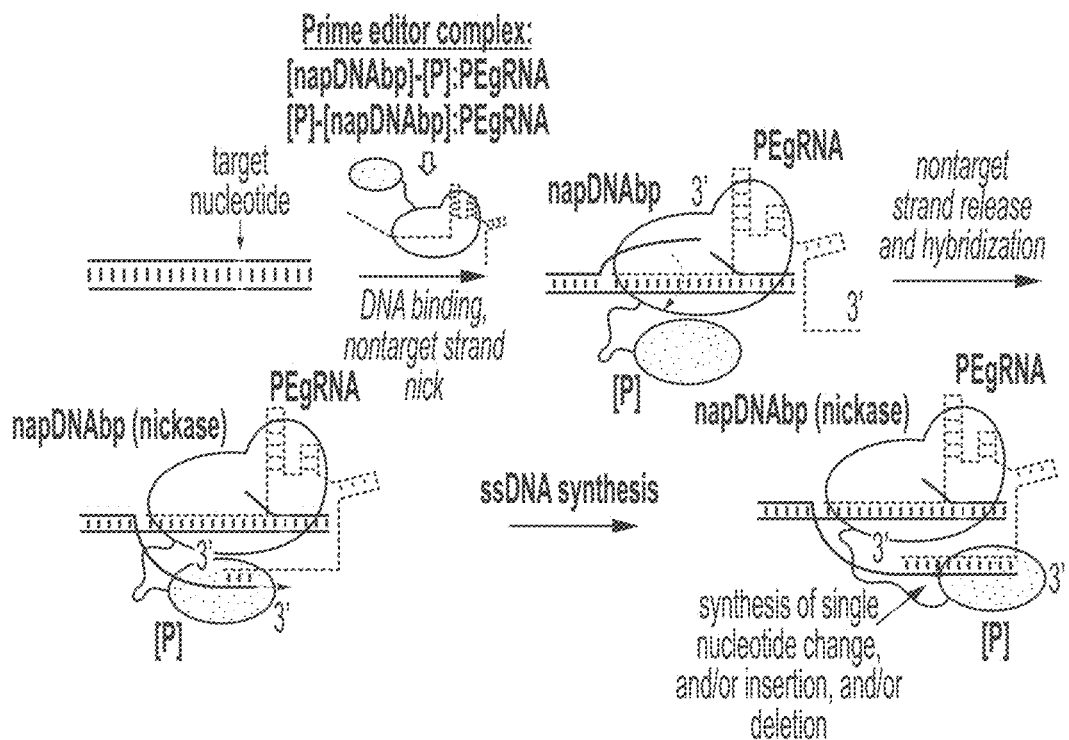
FIG. 1D provides the same representation as in FIG. 1C, except that the prime editor complex is represented more generally as [napDNAbp]-[P]:PEgRNA or [P]-[napDNAbp]:PEgRNA, wherein "P" refers to any polymerase (e.g., a reverse transcriptase), "napDNAbp" refers to a nucleic acid programmable DNA binding protein (e.g., SpCas9), and "PEgRNA" refers to a prime editing guide RNA, and "]-[" refers to an optional linker. As described elsewhere, e.g., FIGS. 3A-3G, the PEgRNA comprises an 3' extension arm comprising a primer binding site and a DNA synthesis template. Although not shown, it is contemplated that the extension arm of the PEgRNA (i.e., which comprises a primer binding site and a DNA synthesis template) can be DNA or RNA. The particular polymerase contemplated in this configuration will depend upon the nature of the DNA synthesis template. For instance, if the DNA synthesis template is RNA, then the polymerase case be an RNA-dependent DNA polymerase (e.g., reverse transcriptase). If the DNA synthesis template is DNA, then the polymerase can be a DNA-dependent DNA polymerase. In various embodiments, the PEgRNA can be engineered or synthesized to incorporate a DNA-based DNA synthesis template.
Figure 1E:
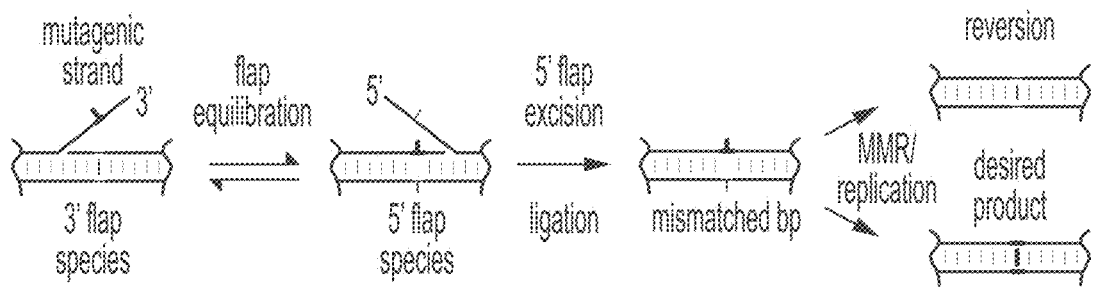
FIG. 1E is a schematic depicting an exemplary process of how the synthesized single strand of DNA (which comprises the desired nucleotide change) becomes resolved such that the desired nucleotide change is incorporated into the DNA. As shown, following synthesis of the edited strand (or "mutagenic strand"), equilibration with the endogenous strand, flap cleavage of the endogenous strand, and ligation leads to incorporation of the DNA edit after resolution of the mismatched DNA duplex through the action of endogenous DNA repair and/or replication processes.
Figure 1F:
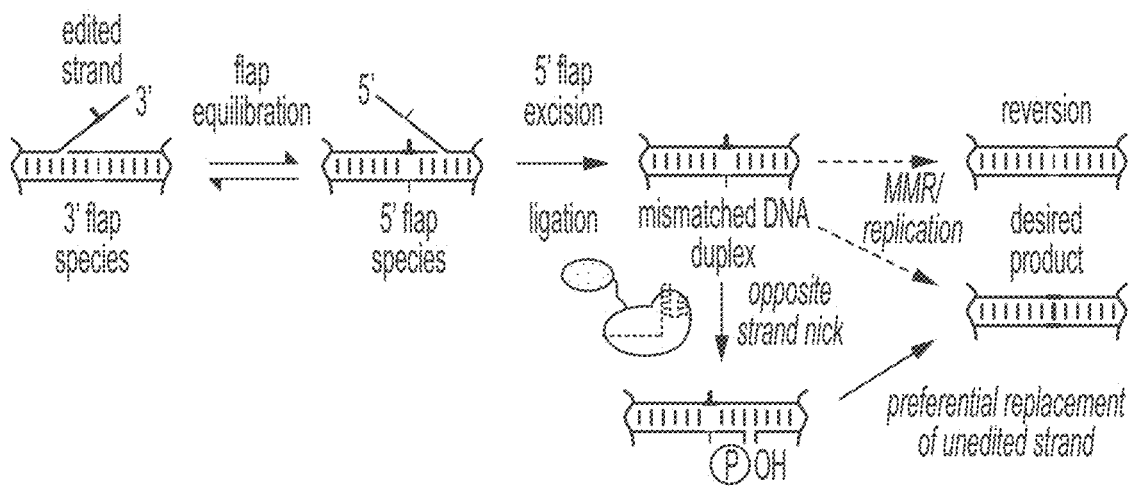
FIG. 1F is a schematic showing that "opposite strand nicking" can be incorporated into the resolution method of FIG. 1E to help drive the formation of the desired product versus the reversion product. In opposite strand nicking, a second Cas9/gRNA complex is used to introduce a second nick on the opposite strand from the initial nicked strand. This induces the endogenous cellular DNA repair and/or replication processes to preferentially replace the unedited strand (i.e., the strand containing the second nick site).
Figure 1G:
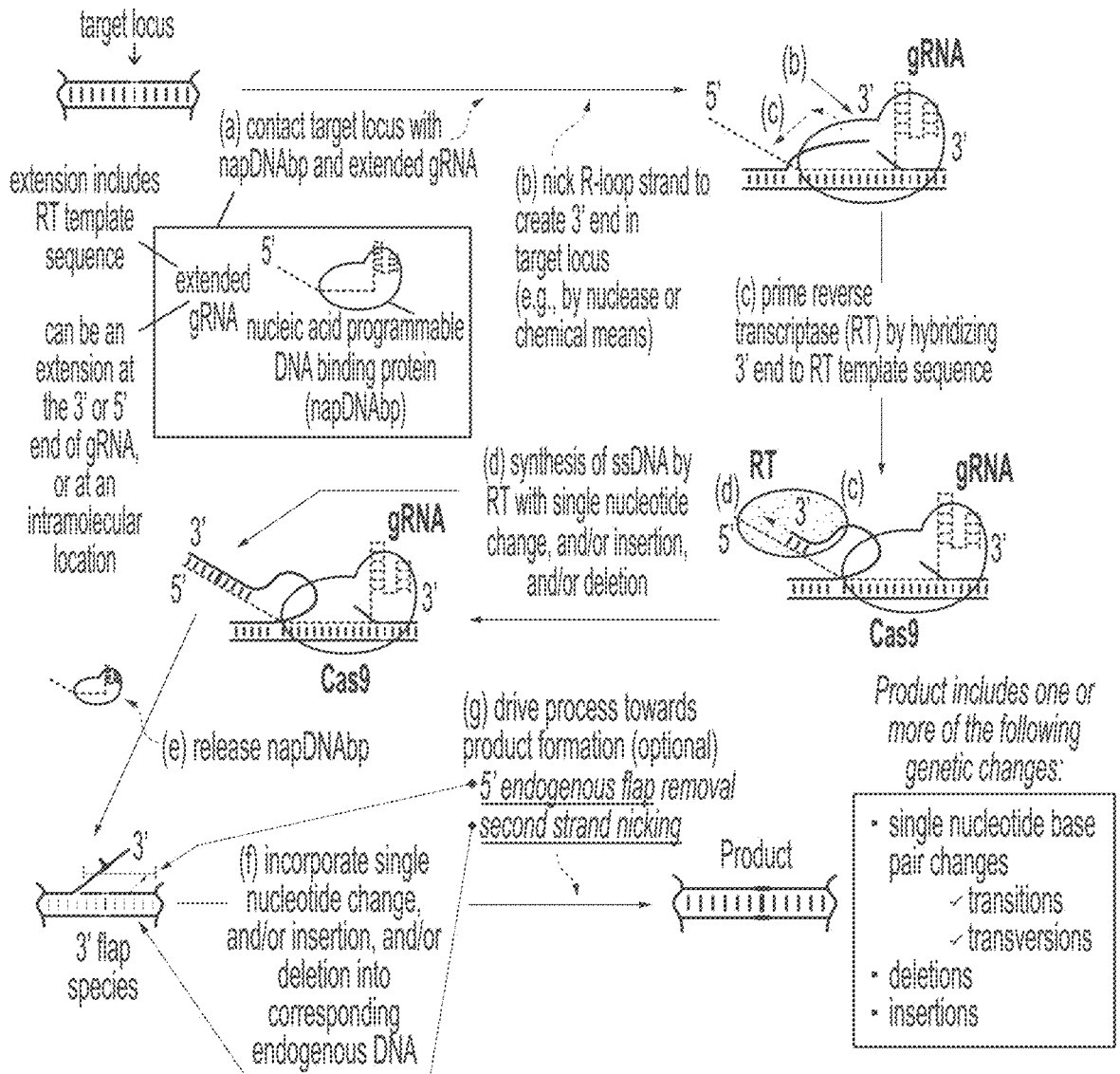
FIG. 1G provides another schematic of an exemplary process for introducing a single nucleotide change, and/or insertion, and/or deletion into a DNA molecule (e.g., a genome) of a target locus using a nucleic acid programmable DNA binding protein (napDNAbp) complexed with an extended guide RNA. This process may be referred to as an embodiment of prime editing. The extended guide RNA comprises an extension at the 3' or 5' end of the guide RNA, or at an intramolecular location in the guide RNA. In step (a), the napDNAbp/gRNA complex contacts the DNA molecule and the gRNA guides the napDNAbp to bind to the target locus. In step (b), a nick in one of the strands of DNA (the R-loop strand, or the PAM-containing strand, or the non-target DNA strand, or the protospacer strand) of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence. In step (c), the 3' end DNA strand interacts with the extended portion of the guide RNA in order to prime reverse transcription. In certain embodiments, the 3' ended DNA strand hybridizes to a specific RT priming sequence on the extended portion of the guide RNA. In step (d), a reverse transcriptase is introduced which synthesizes a single strand of DNA from the 3' end of the primed site towards the 3' end of the guide RNA. This forms a single-strand DNA flap comprising the desired nucleotide change (e.g., the single base change, insertion, or deletion, or a combination thereof). In step (e), the napDNAbp and guide RNA are released. Steps (f) and (g) relate to the resolution of the single strand DNA flap such that the desired nucleotide change becomes incorporated into the target locus. This process can be driven towards the desired product formation by removing the corresponding 5' endogenous DNA flap that forms once the 3' single strand DNA flap invades and hybridizes to the complementary sequence on the other strand. The process can also be driven towards product formation with second strand nicking, as exemplified in FIG. 1F. This process may introduce at least one or more of the following genetic changes: transversions, transitions, deletions, and insertions.
Figure 1H:
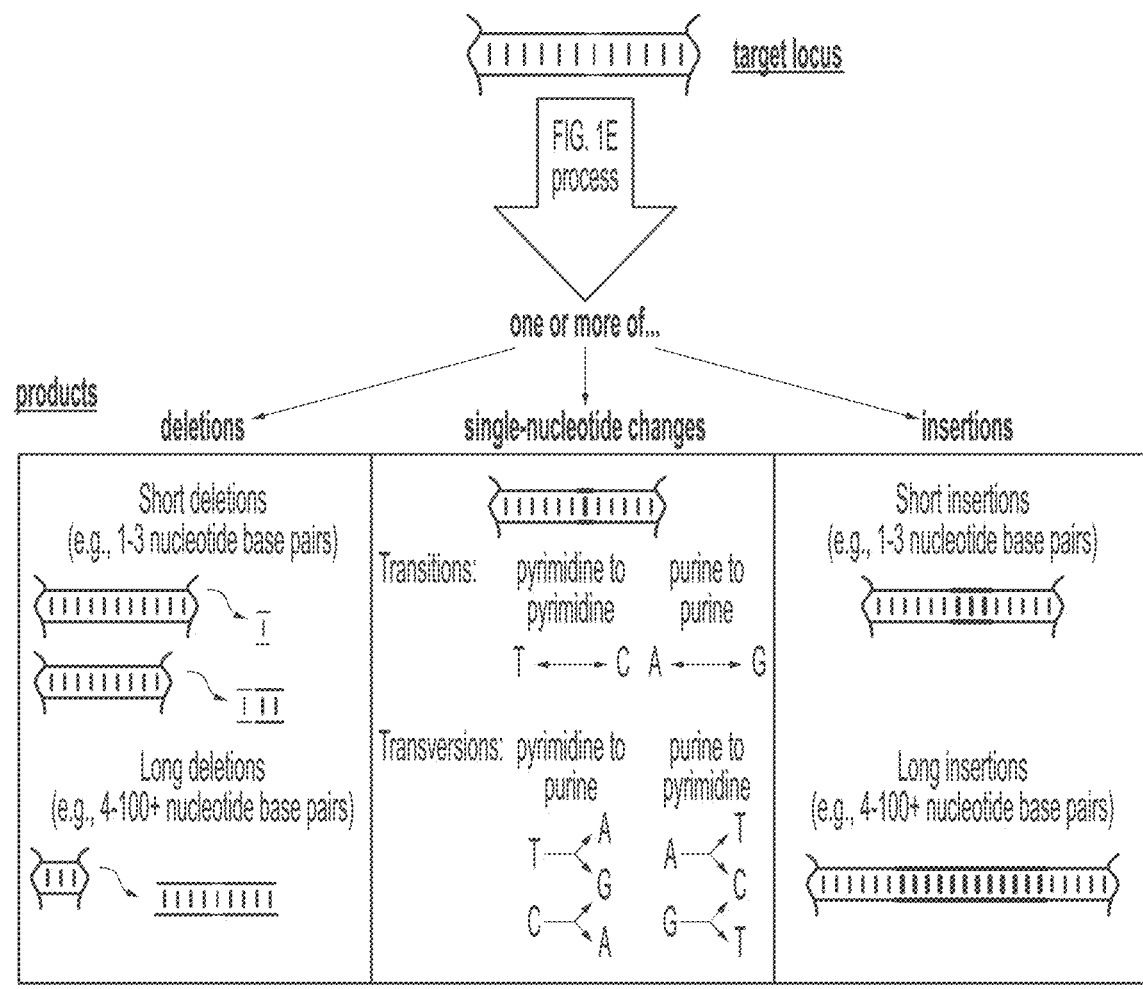
FIG. 1H is a schematic depicting the types of genetic changes that are possible with the prime editing processes described herein. The types of nucleotide changes achievable by prime editing include deletions (including short and long deletions), single-nucleotide changes (including transitions and transversions), inversions, and insertions (including short and long deletions).
Figure 3F:
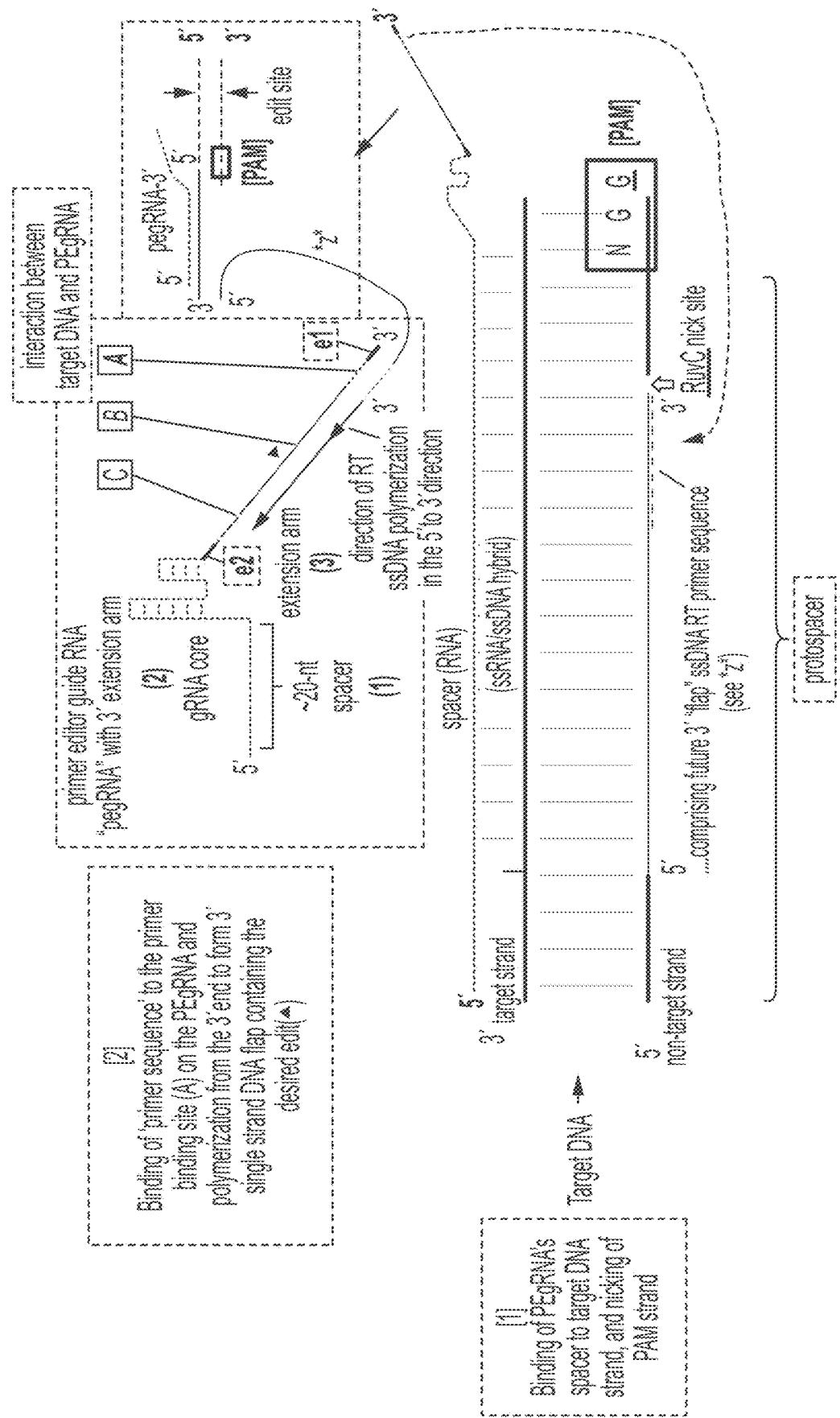

The schematic of FIG. 3F depicts the interaction of a typical PEgRNA with a target site of a double stranded DNA and the concomitant production of a 3' single stranded DNA flap containing the genetic change of interest. The double strand DNA is shown with the top strand (i.e., the target strand) in the 3' to 5' orientation and the lower strand (i.e., the PAM strand or non-target strand) in the 5' to 3' direction. The top strand comprises the complement of the "protospacer" and the complement of the PAM sequence and is referred to as the "target strand" because it is the strand that is target by and anneals to the spacer of the PEgRNA. The complementary lower strand is referred to as the "non-target strand" or the "PAM strand" or the "protospacer strand" since it contains the PAM sequence (e.g., NGG) and the protospacer. Although not shown, the PEgRNA depicted would be complexed with a Cas9 or equivalent domain of a prime editor fusion protein. As shown in the schematic, the spacer of the PEgRNA anneals to the complementary region of the protospacer on the target strand. This interaction forms as DNA/RNA hybrid between the spacer RNA and the complement of the proto spacer DNA, and induces the formation of an R loop in the protospacer. As taught elsewhere herein, the Cas9 protein (not shown) then induces a nick in the non-target strand, as shown. This then leads to the formation of the 3' ssDNA flap region immediately upstream of the nick site which, in accordance with *z*, interacts with the 3' end of the PEgRNA at the primer binding site. The 3' end of the ssDNA flap (i.e., the reverse transcriptase primer sequence) anneals to the primer binding site (A) on the PEgRNA, thereby priming reverse transcriptase. Next, reverse transcriptase (e.g., provided in trans or provided cis as a fusion protein, attached to the Cas9 construct) then polymerizes a single strand of DNA which is coded for by the DNA synthesis template (including the edit template (B) and homology arm (C)). The polymerization continues towards the 5' end of the extension arm. The polymerized strand of ssDNA forms a ssDNA 3' end flap which, as describe elsewhere (e.g., as shown in FIG. 1G), invades the endogenous DNA, displacing the corresponding endogenous strand (which is removed as a 5' ended DNA flap of endogenous DNA), and installing the desired nucleotide edit (single nucleotide base pair change, deletions, insertions (including whole genes) through naturally occurring DNA repair/replication rounds.

FIG. 3G depicts yet another embodiment of prime editing contemplated herein. In particular, the top schematic depicts one embodiment of a prime editor (PE), which comprises a fusion protein of a napDNAbp (e.g., SpCas9) and a polymerase (e.g., a reverse transcriptase), which are joined by a linker. The PE forms a complex with a PEgRNA by binding to the gRNA core of the PEgRNA. In the embodiment shown, the PEgRNA is equipped with a 3' extension arm that comprises, beginning at the 3' end, a primer binding site (PBS) followed by a DNA synthesis template. The bottom schematic depicts a variant of a prime editor, referred to as a "trans prime editor (tPE)." In this embodiment, the DNA synthesis template and PBS are decoupled from the PEgRNA and presented on a separate molecule, referred to as a trans prime editor RNA template ("tPERT"), which comprises an RNA-protein recruitment domain (e.g., a MS2 hairpin). The PE itself is further modified to comprise a fusion to a rPERT recruiting protein ("RP"), which is a protein which specifically recognizes and binds to the RNA-protein recruitment domain. In the example where the RNA-protein recruitment domain is an MS2 hairpin, the corresponding rPERT recruiting protein can be MS2cp of the MS2 tagging system. The MS2 tagging system is based on the natural interaction of the MS2 bacteriophage coat protein ("MCP" or "MS2cp") with a stem-loop or hairpin structure present in the genome of the phage, i.e., the "MS2 hairpin" or "MS2 aptamer." In the case of trans prime editing, the RP-PE:gRNA complex "recruits" a tPERT having the appropriate RNA-protein recruitment domain to co-localize with the PE:gRNA complex, thereby providing the PBS and DNA synthesis template in trans for use in prime editing, as shown in the example depicted in FIG. 3H.

FIG. 3H depicts the process of trans prime editing. In this embodiment, the trans prime editor comprises a "PE2" prime editor (i.e., a fusion of a Cas9(H840A) and a variant MMLV RT) fused to an MS2cp protein (i.e., a type of recruiting protein that recognizes and binds to an MS2 aptamer) and which is complexed with an sgRNA (i.e., a standard guide RNA as opposed to a PEgRNA). The trans prime editor binds to the target DNA and nicks the nontarget strand. The MS2cp protein recruits a tPERT in trans through the specific interaction with the RNA-protein recruitment domain on the tPERT molecule. The tPERT becomes co-localized with the trans prime editor, thereby providing the PBS and DNA synthesis template functions in trans for use by the reverse transcriptase polymerase to synthesize a single strand DNA flap having a 3' end and containing the desired genetic information encoded by the DNA synthesis template.

Figure 4D:
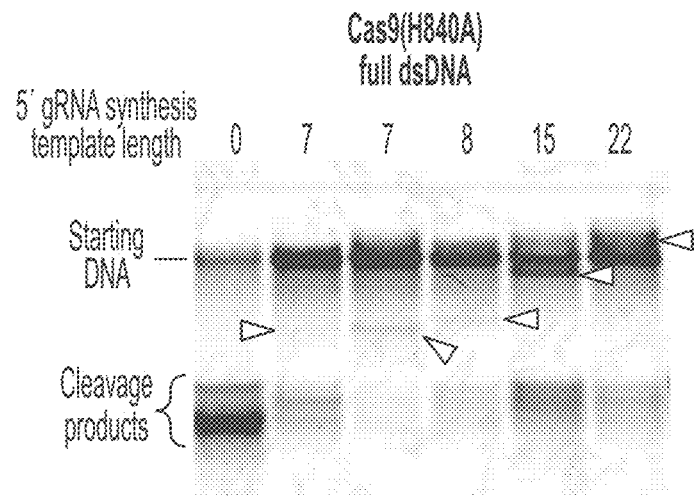
Figure 4E:
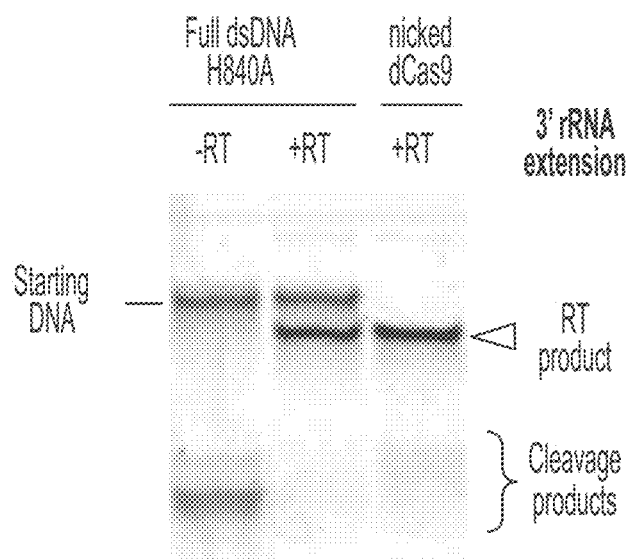

FIGS. 4A-4E demonstrate in vitro TPRT assays (i.e., prime editing assays). FIG. 4A is a schematic of fluorescently labeled DNA substrates gRNA templated extension by an RT enzyme, PAGE. FIG. 4B shows TPRT (i.e., prime editing) with pre-nicked substrates, dCas9, and 5'-extended gRNAs of differing synthesis template length. FIG. 4C shows the RT reaction with pre-nicked DNA substrates in the absence of Cas9. FIG. 4D shows TPRT (i.e., prime editing) on full dsDNA substrates with Cas9(H840A) and 5'-extended gRNAs. FIG. 4E shows a 3'-extended gRNA template with pre-nicked and full dsDNA substrates. All reactions are with M-MLV RT.

FIG. 5 shows in vitro validations using 5'-extended gRNAs with varying length synthesis templates. Fluorescently labeled (Cy5) DNA targets were used as substrates, and were pre-nicked in this set of experiments. The Cas9 used in these experiments is catalytically dead Cas9 (dCas9), and the RT used is Superscript III, a commercial RT derived from the Moloney-Murine Leukemia Virus (M-MLV). dCas9:gRNA complexes were formed from purified components. Then, the fluorescently labeled DNA substrate was added along with dNTPs and the RT enzyme. After 1 hour of incubation at 37° C., the reaction products were analyzed by denaturing urea-polyacrylamide gel electrophoresis (PAGE). The gel image shows extension of the original DNA strand to lengths that are consistent with the length of the reverse transcription template.

FIG. 6 shows in vitro validations using 5'-extended gRNAs with varying length synthesis templates, which closely parallels those shown in FIG. 5. However, the DNA substrates are not pre-nicked in this set of experiments. The Cas9 used in these experiments is a Cas9 nickase (SpyCas9 H840A mutant) and the RT used is Superscript III, a commercial RT derived from the Moloney-Murine Leukemia Virus (M-MLV). The reaction products were analyzed by denaturing urea-polyacrylamide gel electrophoresis (PAGE). As shown in the gel, the nickase efficiently cleaves the DNA strand when the standard gRNA is used (gRNA_0, lane 3).

FIG. 7 demonstrates that 3' extensions support DNA synthesis and do not significantly effect Cas9 nickase activity. Pre-nicked substrates (black arrow) are near-quantitatively converted to RT products when either dCas9 or Cas9 nickase is used (lanes 4 and 5). Greater than 50% conversion to the RT product (red arrow) is observed with full substrates (lane 3). Cas9 nickase (SpyCas9 H840A mutant), catalytically dead Cas9 (dCas9) and Superscript III, a commercial RT derived from the Moloney-Murine Leukemia Virus (M-MLV) are used.

Figure 8:
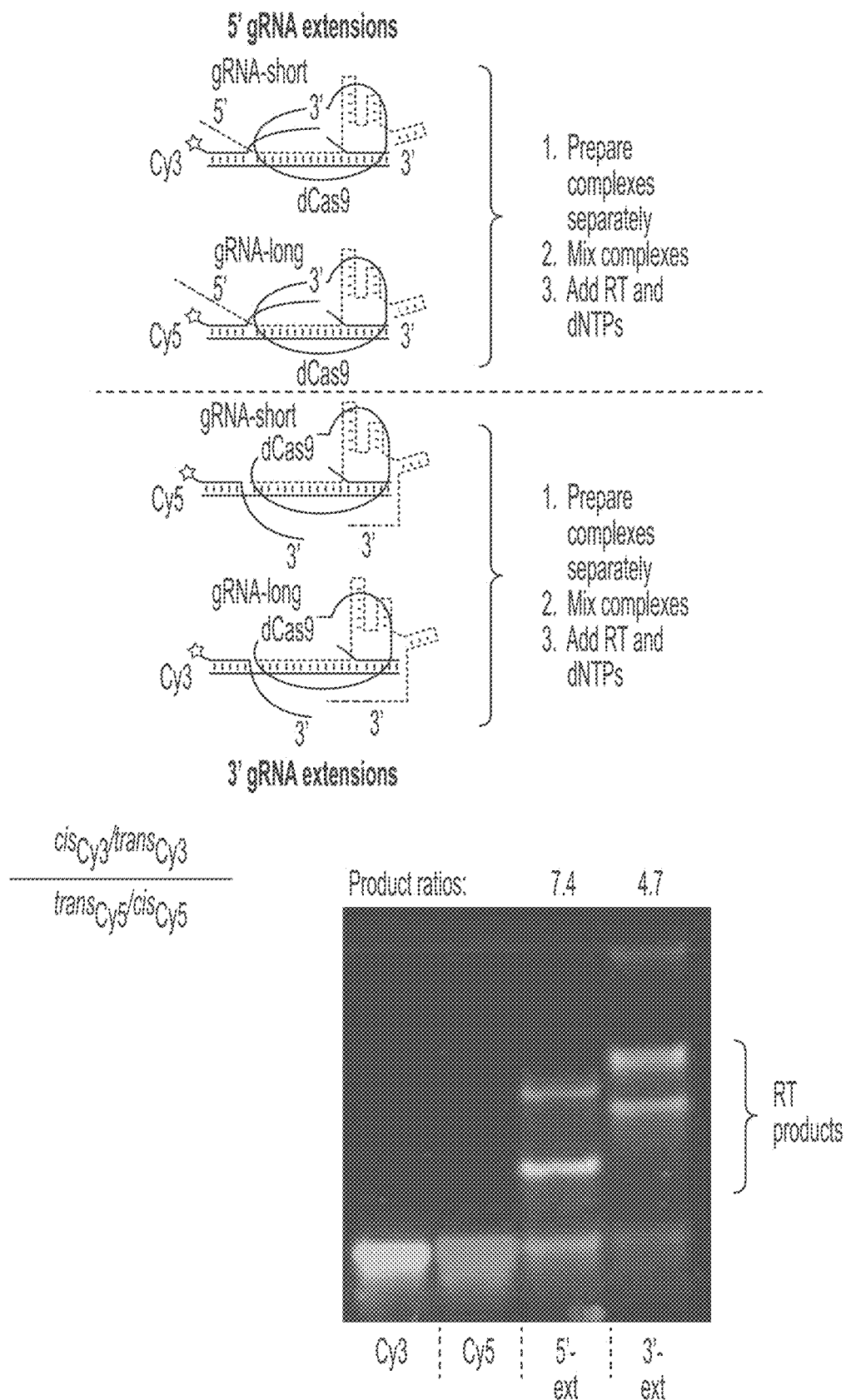

FIG. 8 demonstrates dual color experiments that were used to determine if the RT reaction preferentially occurs with the gRNA in cis (bound in the same complex). Two separate experiments were conducted for 5'-extended and 3'-extended gRNAs. Products were analyzed by PAGE. Product ratio calculated as (Cy3cis/Cy3trans)/(Cy5trans/Cy5cis).

Figure 9A:
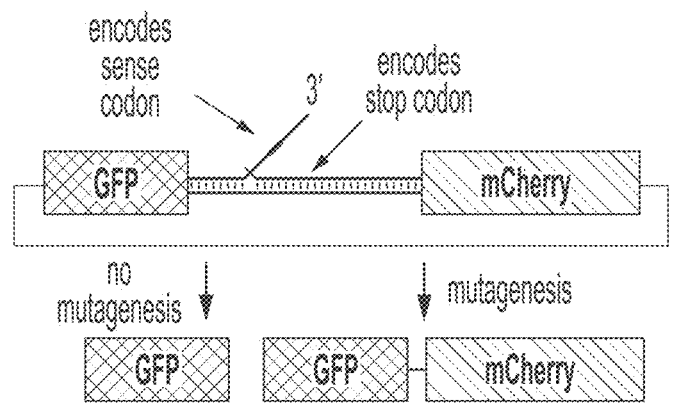
Figure 9B:
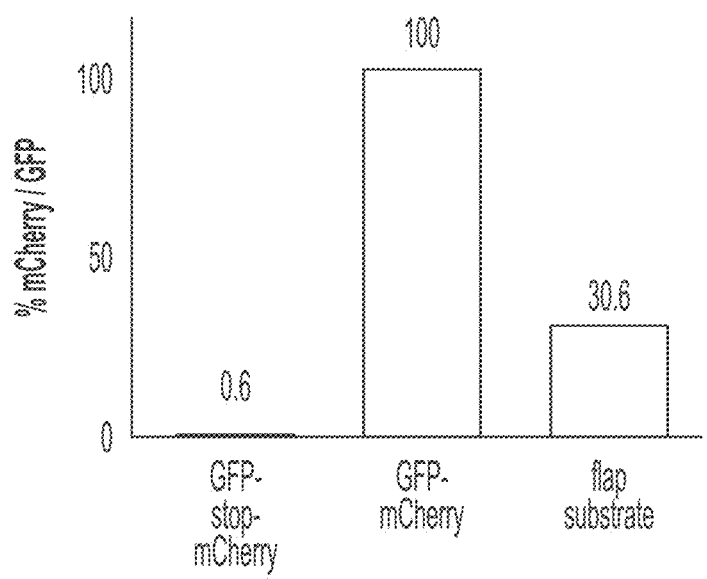
Figures 9C, 9D:
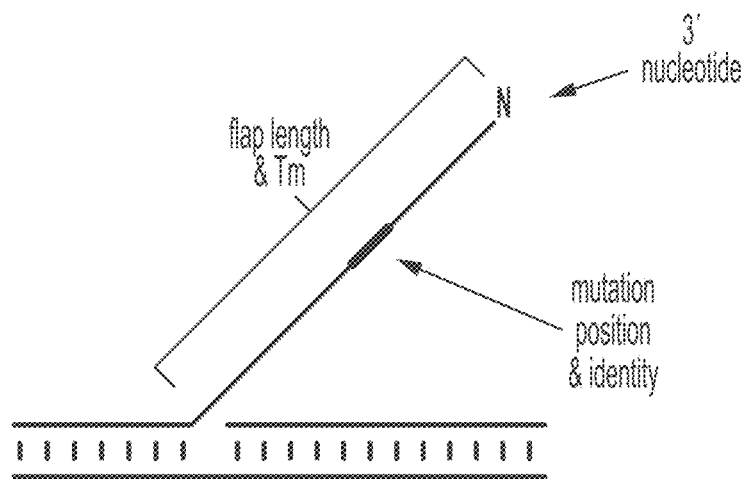

FIGS. 9A-9D demonstrates a flap model substrate. FIG. 9A shows a dual-FP reporter for flap-directed mutagenesis. FIG. 9B shows stop codon repair in HEK cells. FIG. 9C shows sequenced yeast clones after flap repair. FIG. 9D shows testing of different flap features in human cells.

Figure 10:
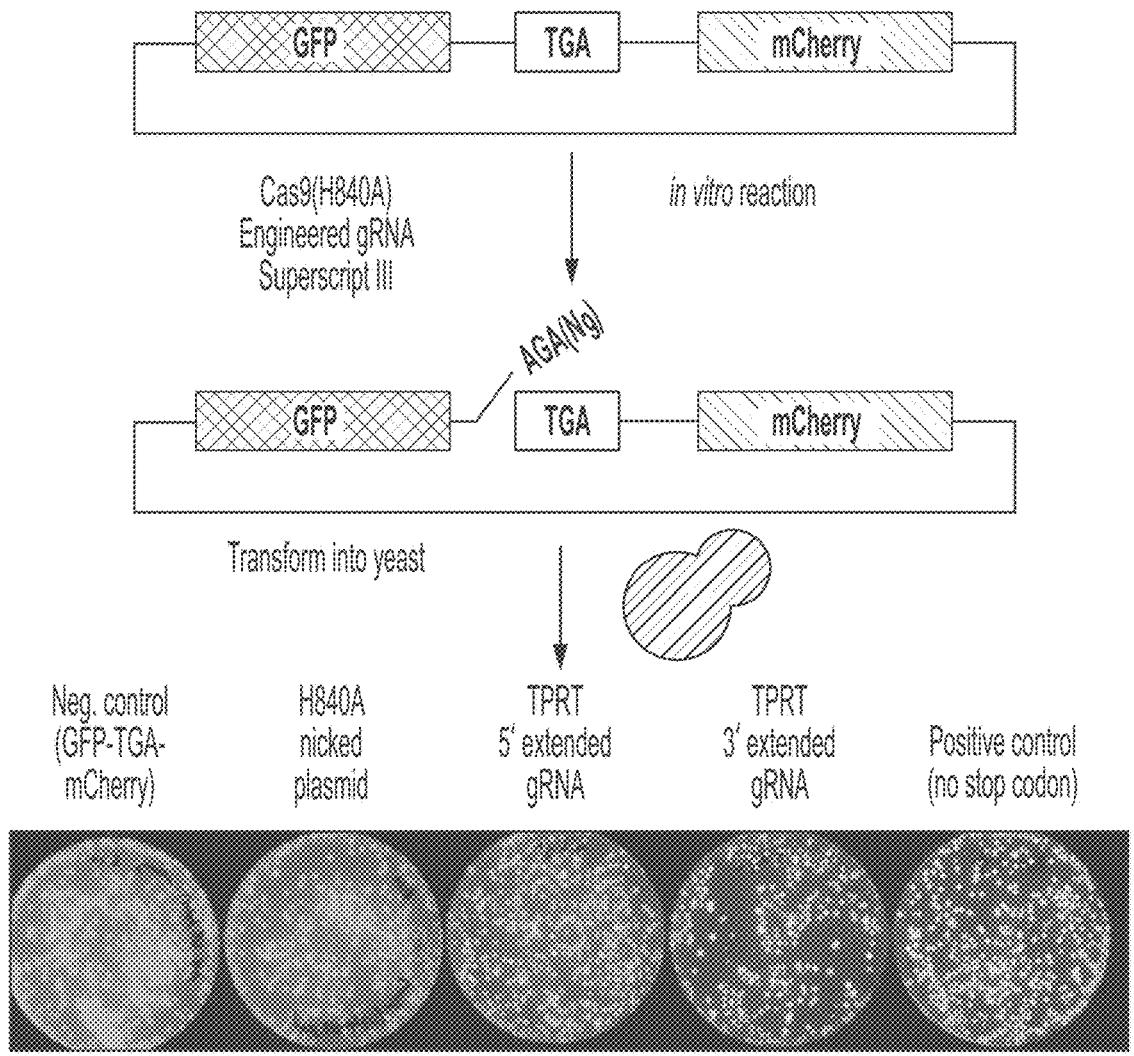

FIG. 10 demonstrates prime editing on plasmid substrates. A dual-fluorescent reporter plasmid was constructed for yeast (S. cerevisiae) expression. Expression of this construct in yeast produces only GFP. The in vitro prime editing reaction introduces a point mutation, and transforms the parent plasmid or an in vitro Cas9(H840A) nicked plasmid into yeast. The colonies are visualized by fluorescence imaging. Yeast dual-FP plasmid transformants are shown. Transforming the parent plasmid or an in vitro Cas9(H840A) nicked plasmid results in only green GFP expressing colonies. The prime editing reaction with 5'-extended or 3'-extended gRNAs produces a mix of green and yellow colonies. The latter express both GFP and mCherry. More yellow colonies are observed with the 3'-extended gRNA. A positive control that contains no stop codon is shown as well.

Figure 11:
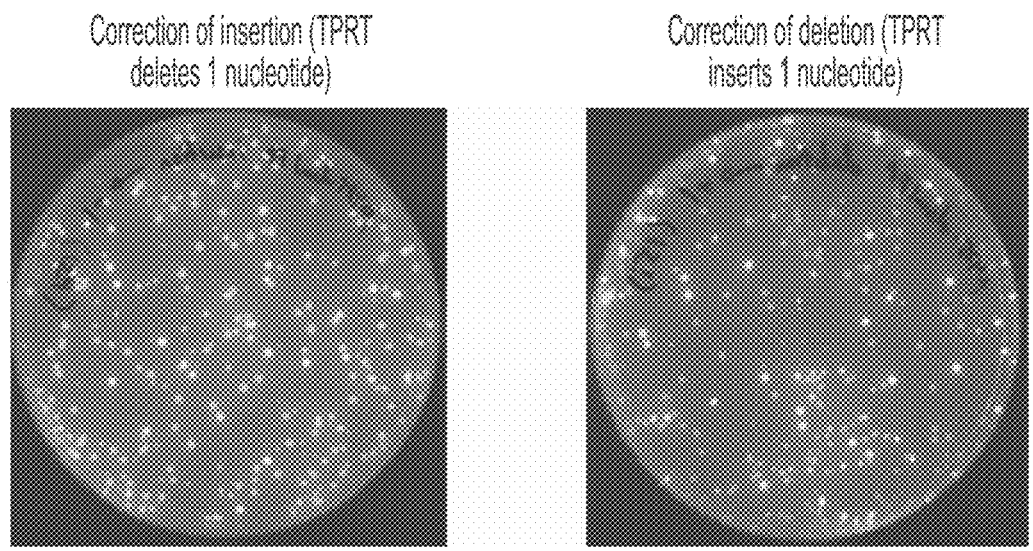

FIG. 11 shows prime editing on plasmid substrates similar to the experiment in FIG. 10, but instead of installing a point mutation in the stop codon, prime editing installs a single nucleotide insertion (left) or deletion (right) that repairs a frameshift mutation and allows for synthesis of downstream mCherry. Both experiments used 3' extended gRNAs.

FIG. 12 shows editing products of prime editing on plasmid substrates, characterized by Sanger sequencing. Individually colonies from the TRT transformations were selected and analyzed by Sanger sequencing. Precise edits were observed by sequencing select colonies. Green colonies contained plasmids with the original DNA sequence, while yellow colonies contained the precise mutation designed by the prime editing gRNA. No other point mutations or indels were observed.

Figure 13:
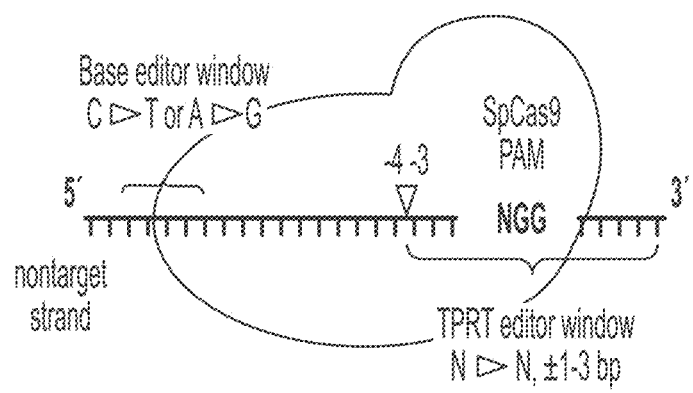

FIG. 13 shows the potential scope for the new prime editing technology is shown and compared to deaminase-mediated base editor technologies.

Figure 14:
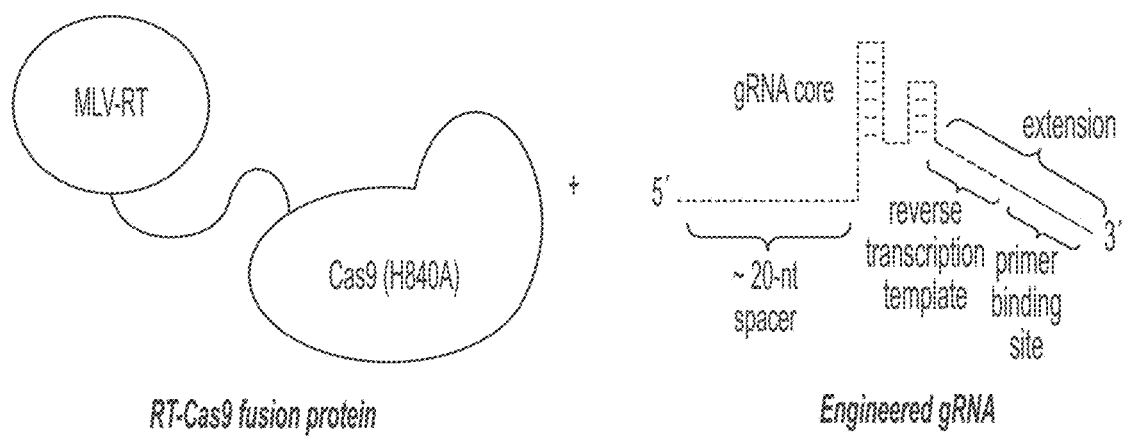

FIG. 14 shows a schematic of editing in human cells.

Figures 15, 16:
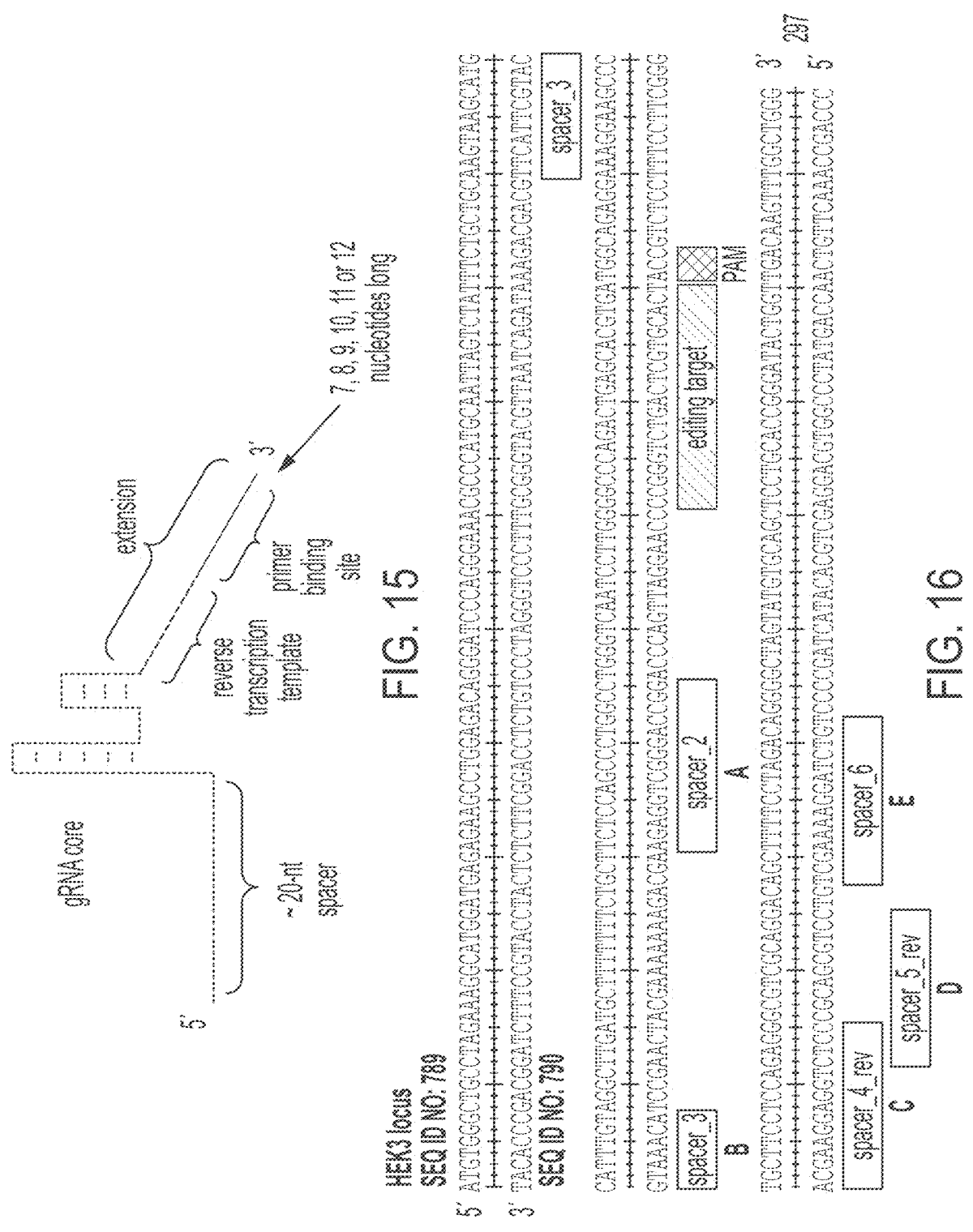

FIG. 15 demonstrates the extension of the primer binding site in gRNA.

FIG. 16 shows truncated gRNAs for adjacent targeting.

Figure 17A:
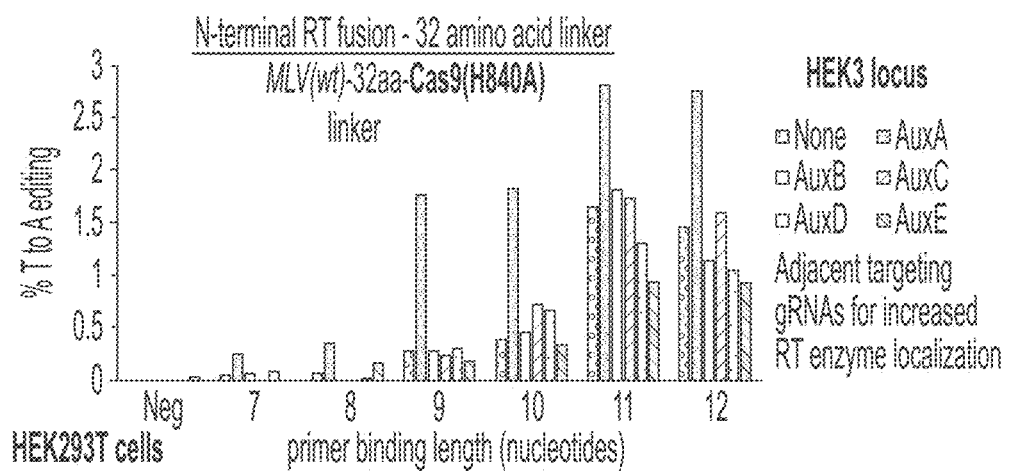
Figure 17B:
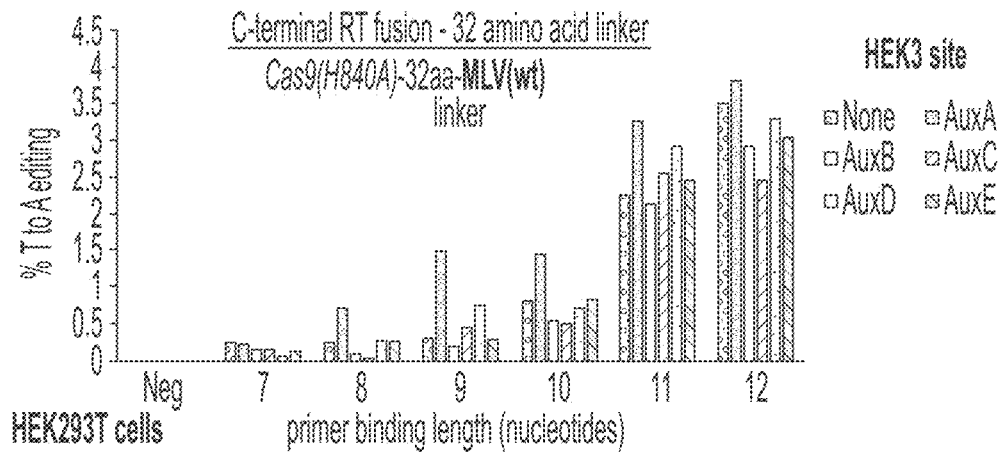
Figure 17C:
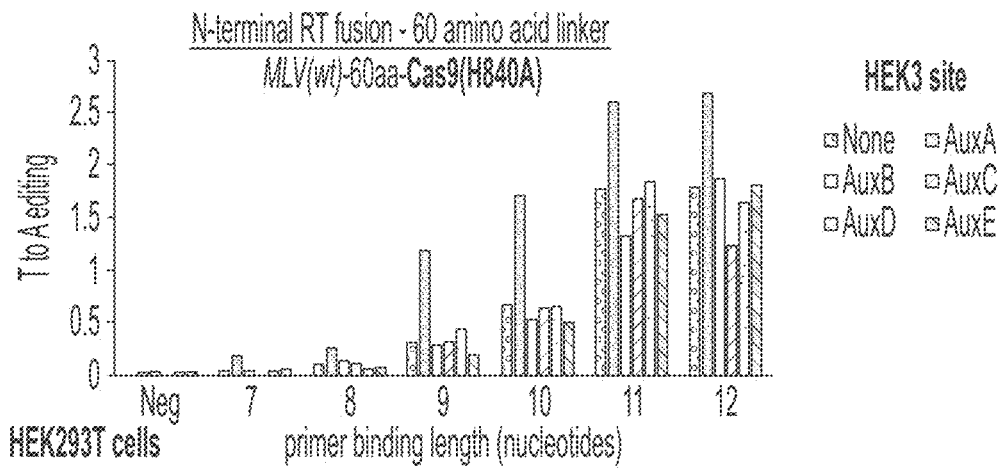

FIGS. 17A-17C are graphs displaying the % T to A conversion at the target nucleotide after transfection of components in human embryonic kidney (HEK) cells. FIG. 17A shows data, which presents results using an N-terminal fusion of wild type MLV reverse transcriptase to Cas9 (H840A) nickase (32-amino acid linker). FIG. 17B is similar to FIG. 17A, but for C-terminal fusion of the RT enzyme. FIG. 17C is similar to FIG. 17A but the linker between the MLV RT and Cas9 is 60 amino acids long instead of 32 amino acids.

FIG. 18 shows high purity T to A editing at HEK3 site by high-throughput amplicon sequencing. The output of sequencing analysis displays the most abundant genotypes of edited cells.

Figure 19:
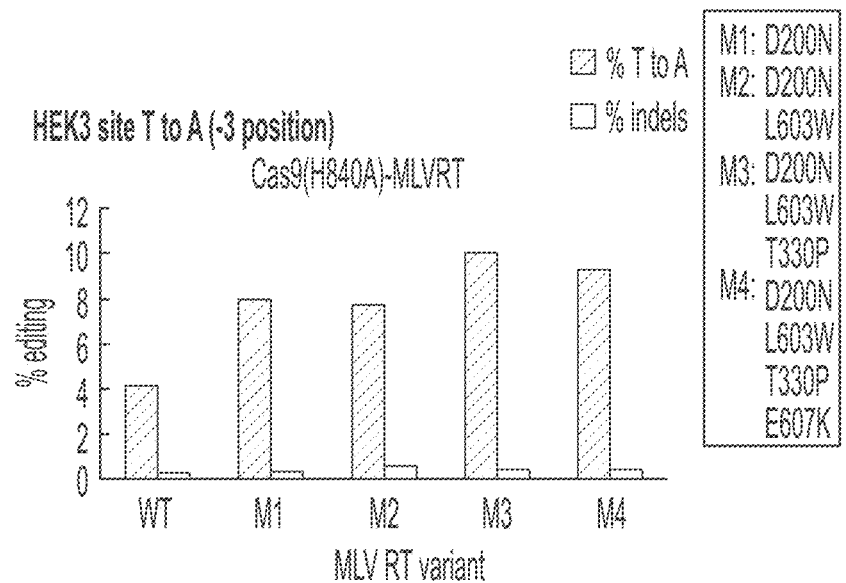

FIG. 19 shows editing efficiency at the target nucleotide (blue bars) alongside indel rates (orange bars). WT refers to the wild type MLV RT enzyme. The mutant enzymes (Ml through M4) contain the mutations listed to the right. Editing rates were quantified by high throughput sequencing of genomic DNA amplicons.

Figure 20:
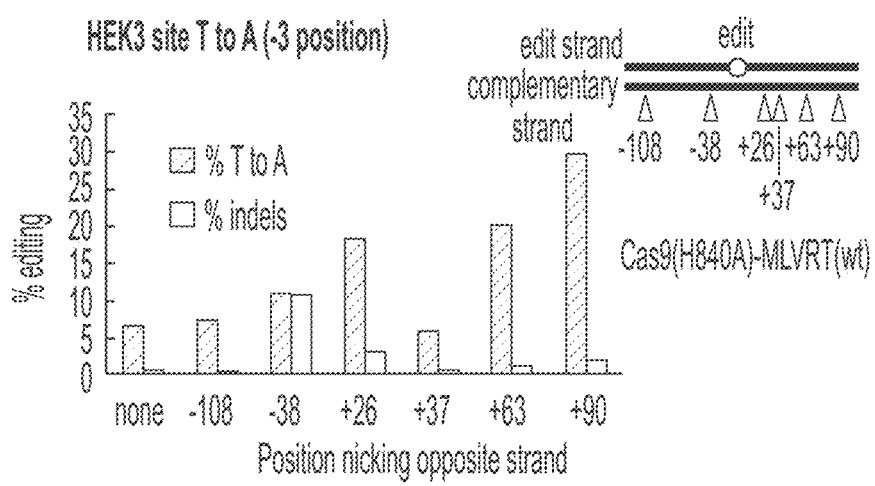

FIG. 20 shows editing efficiency of the target nucleotide when a single strand nick is introduced in the complementary DNA strand in proximity to the target nucleotide. Nicking at various distances from the target nucleotide was tested (triangles). Editing efficiency at the target base pair (blue bars) is shown alongside the indel formation rate (orange bars). The "none" example does not contain a complementary strand nicking guide RNA. Editing rates were quantified by high throughput sequencing of genomic DNA amplicons.

Figure 21:
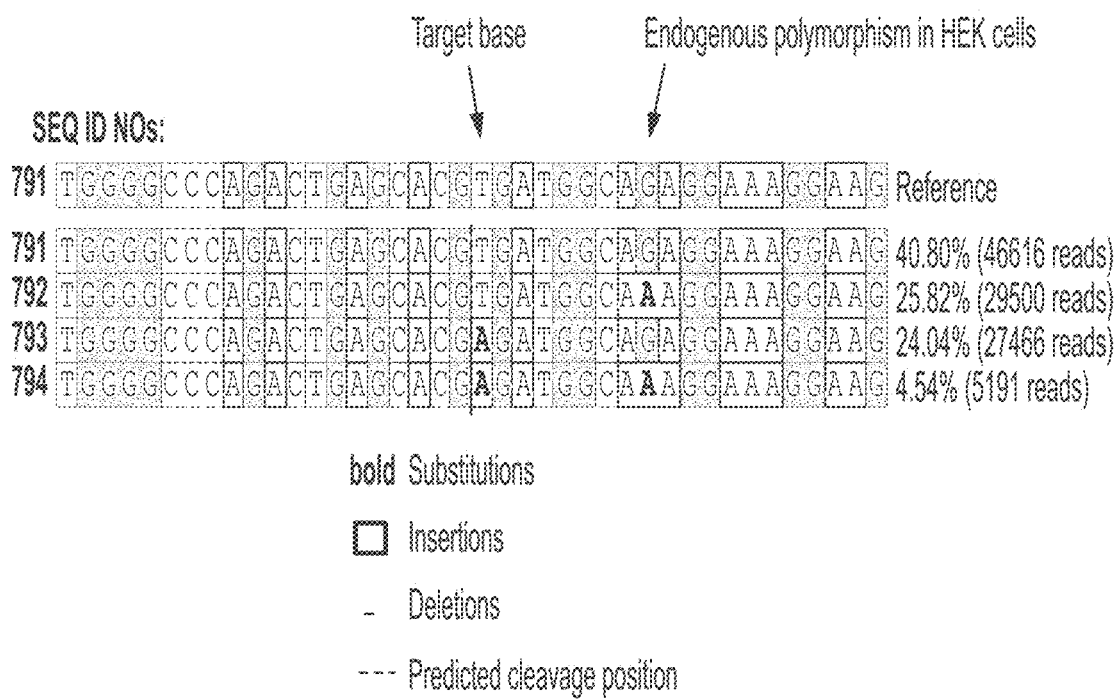

FIG. 21 demonstrates processed high throughput sequencing data showing the desired T to A transversion mutation and general absence of other major genome editing byproducts.

Figure 22:
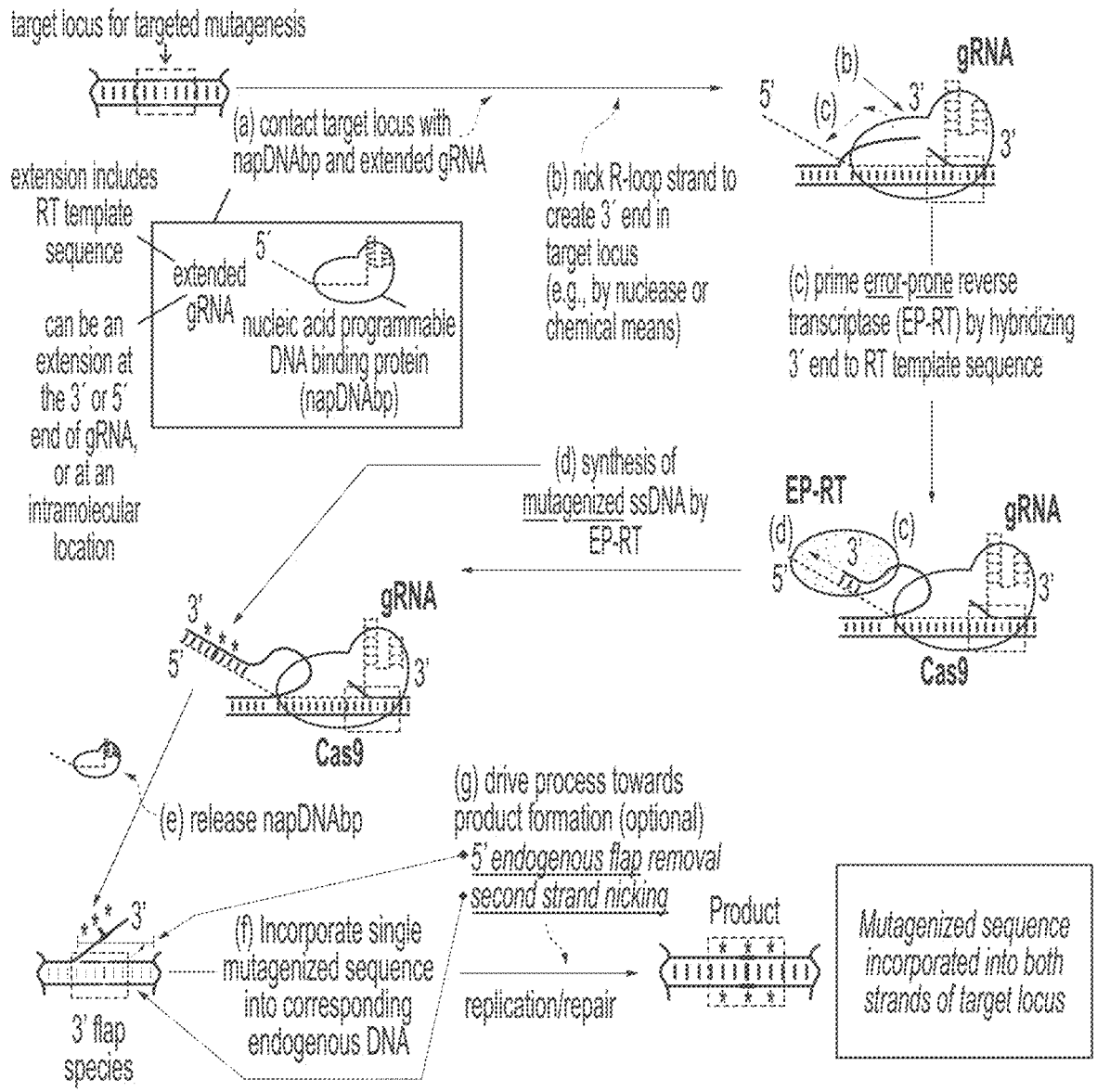

FIG. 22 provides a schematic of an exemplary process for conducting targeted mutagenesis with an error-prone reverse transcriptase on a target locus using a nucleic acid programmable DNA binding protein (napDNAbp) complexed with an extended guide RNA, i.e., prime editing with an error-prone RT. This process may be referred to as an embodiment of prime editing for targeted mutagenesis. The extended guide RNA comprises an extension at the 3' or 5' end of the guide RNA, or at an intramolecular location in the guide RNA. In step (a), the napDNAbp/gRNA complex contacts the DNA molecule and the gRNA guides the napDNAbp to bind to the target locus to be mutagenized. In step (b), a nick in one of the strands of DNA of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence. In step (c), the 3' end DNA strand interacts with the extended portion of the guide RNA in order to prime reverse transcription. In certain embodiments, the 3' ended DNA strand hybridizes to a specific RT priming sequence on the extended portion of the guide RNA. In step (d), an error-prone reverse transcriptase is introduced which synthesizes a mutagenized single strand of DNA from the 3' end of the primed site towards the 3' end of the guide RNA. Exemplary mutations are indicated with an asterisk "*". This forms a single-strand DNA flap comprising the desired mutagenized region. In step (e), the napDNAbp and guide RNA are released. Steps (f) and (g) relate to the resolution of the single strand DNA flap (comprising the mutagenized region) such that the desired mutagenized region becomes incorporated into the target locus. This process can be driven towards the desired product formation by removing the corresponding 5' endogenous DNA flap that forms once the 3' single strand DNA flap invades and hybridizes to the complementary sequence on the other strand. The process can also be driven towards product formation with second strand nicking, as exemplified in FIG. 1F. Following endogenous DNA repair and/or replication processes, the mutagenized region becomes incorporated into both strands of DNA of the DNA locus.

FIG. 23 is a schematic of gRNA design for contracting trinucleotide repeat sequences and trinucleotide repeat contraction with TPRT genome editing (i.e., prime editing). Trinucleotide repeat expansion is associated with a number of human diseases, including Huntington's disease, Fragile X syndrome, and Friedreich's ataxia. The most common trinucleotide repeat contains CAG triplets, though GAA triplets (Friedreich's ataxia) and CGG triplets (Fragile X syndrome) also occur. Inheriting a predisposition to expansion, or acquiring an already expanded parental allele, increases the likelihood of acquiring the disease. Pathogenic expansions of trinucleotide repeats could hypothetically be corrected using prime editing. A region upstream of the repeat region can be nicked by an RNA-guided nuclease, then used to prime synthesis of a new DNA strand that contains a healthy number of repeats (which depends on the particular gene and disease). After the repeat sequence, a short stretch of homology is added that matches the identity of the sequence adjacent to the other end of the repeat (red strand). Invasion of the newly synthesized strand, and subsequent replacement of the endogenous DNA with the newly synthesized flap, leads to a contracted repeat allele.

Figure 24:
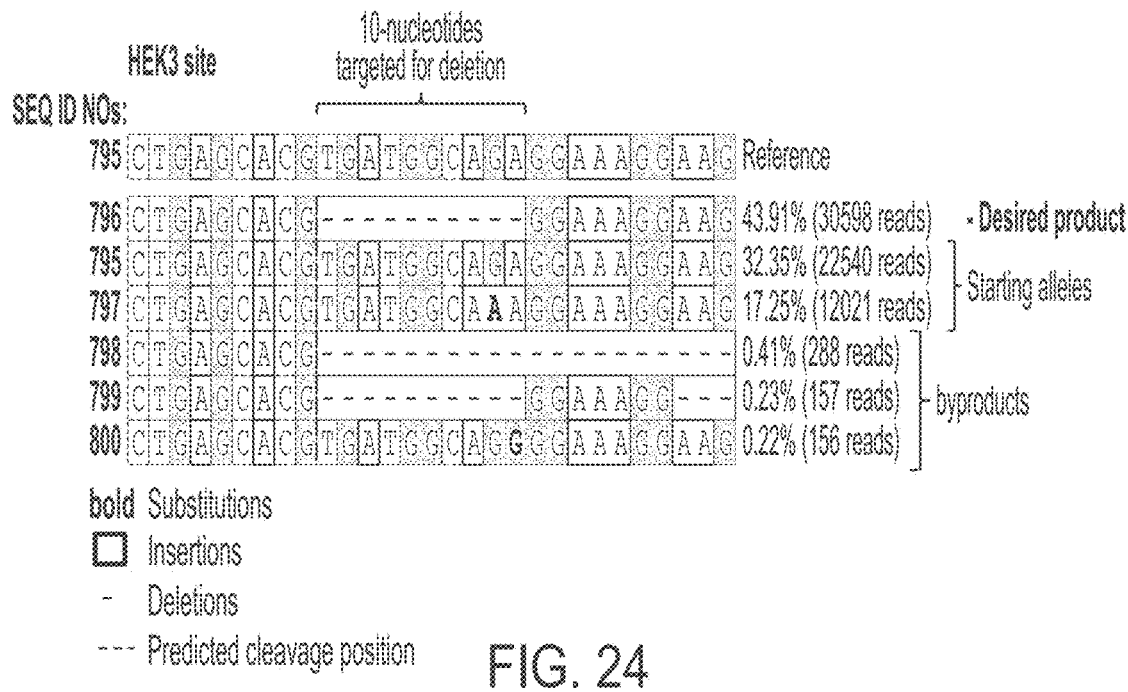

FIG. 24 is a schematic showing precise 10-nucleotide deletion with prime editing. A guide RNA targeting the HEK3 locus was designed with a reverse transcription template that encodes a 10-nucleotide deletion after the nick site. Editing efficiency in transfected HEK cells was assessed using amplicon sequencing.

Figure 25:
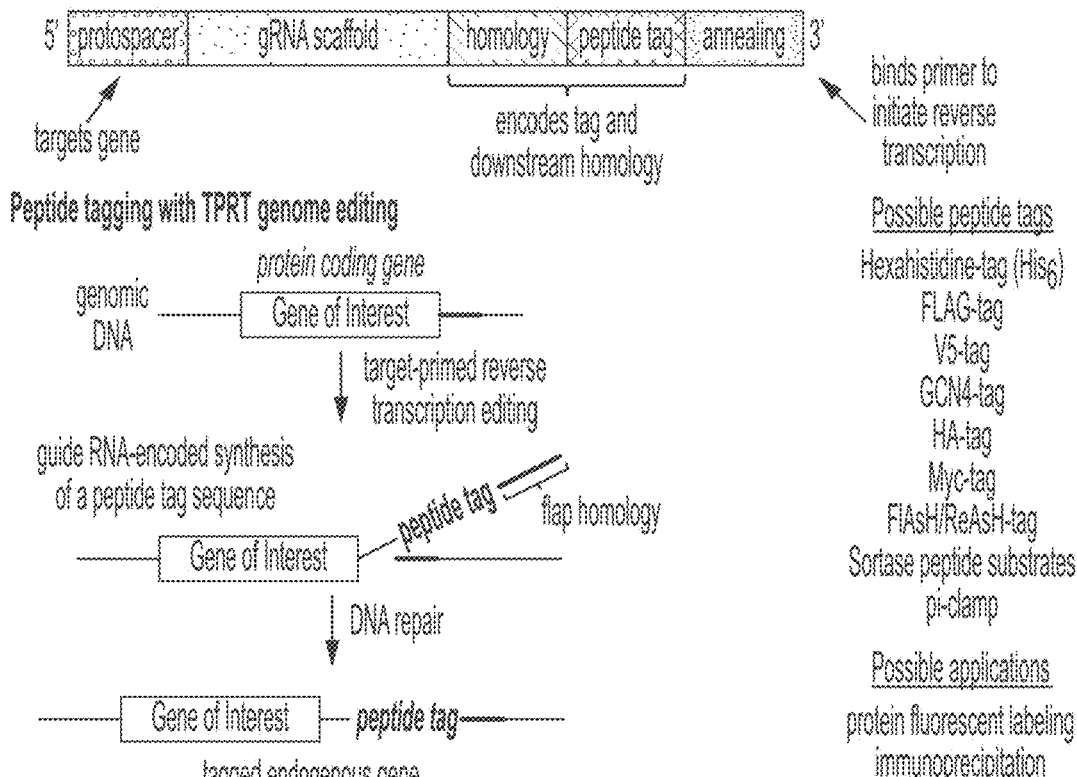

FIG. 25 is a schematic showing gRNA design for peptide tagging genes at endogenous genomic loci and peptide tagging with TPRT genome editing (i.e., prime editing). The FlAsH and ReAsH tagging systems comprise two parts: (1) a fluorophore-biarsenical probe, and (2) a genetically encoded peptide containing a tetracysteine motif, exemplified by the sequence FLNCCPGCCMEP (SEQ ID NO: 1). When expressed within cells, proteins containing the tetracysteine motif can be fluorescently labeled with fluorophore-arsenic probes (see ref: J. Am. Chem. Soc., 2002, 124 (21), pp 6063-6076. DOI: 10.1021/ja017687n). The "sortagging" system employs bacterial sortase enzymes that covalently conjugate labeled peptide probes to proteins containing suitable peptide substrates (see ref: Nat. Chem. Biol. 2007 November; 3(11):707-8. DOI: 10.1038/nchembio.2007.31). The FLAG-tag (DYKDDDDK (SEQ ID NO: 2)), V5-tag (GKPIPNPLLGLDST (SEQ ID NO: 3)), GCN4-tag (EELLSKNYHLENEVARLKK (SEQ ID NO: 4)), HA-tag (YPYDVPDYA (SEQ ID NO: 5)), and Myc-tag (EQKLISEEDL (SEQ ID NO: 6)) are commonly employed as epitope tags for immunoassays. The pi-clamp encodes a peptide sequence (FCPF (SEQ ID NO: 622)) that can by labeled with a pentafluoro-aromatic substrates (ref: Nat. Chem. 2016 February; 8(2):120-8. doi: 10.1038/nchem.2413).

Figure 26A:
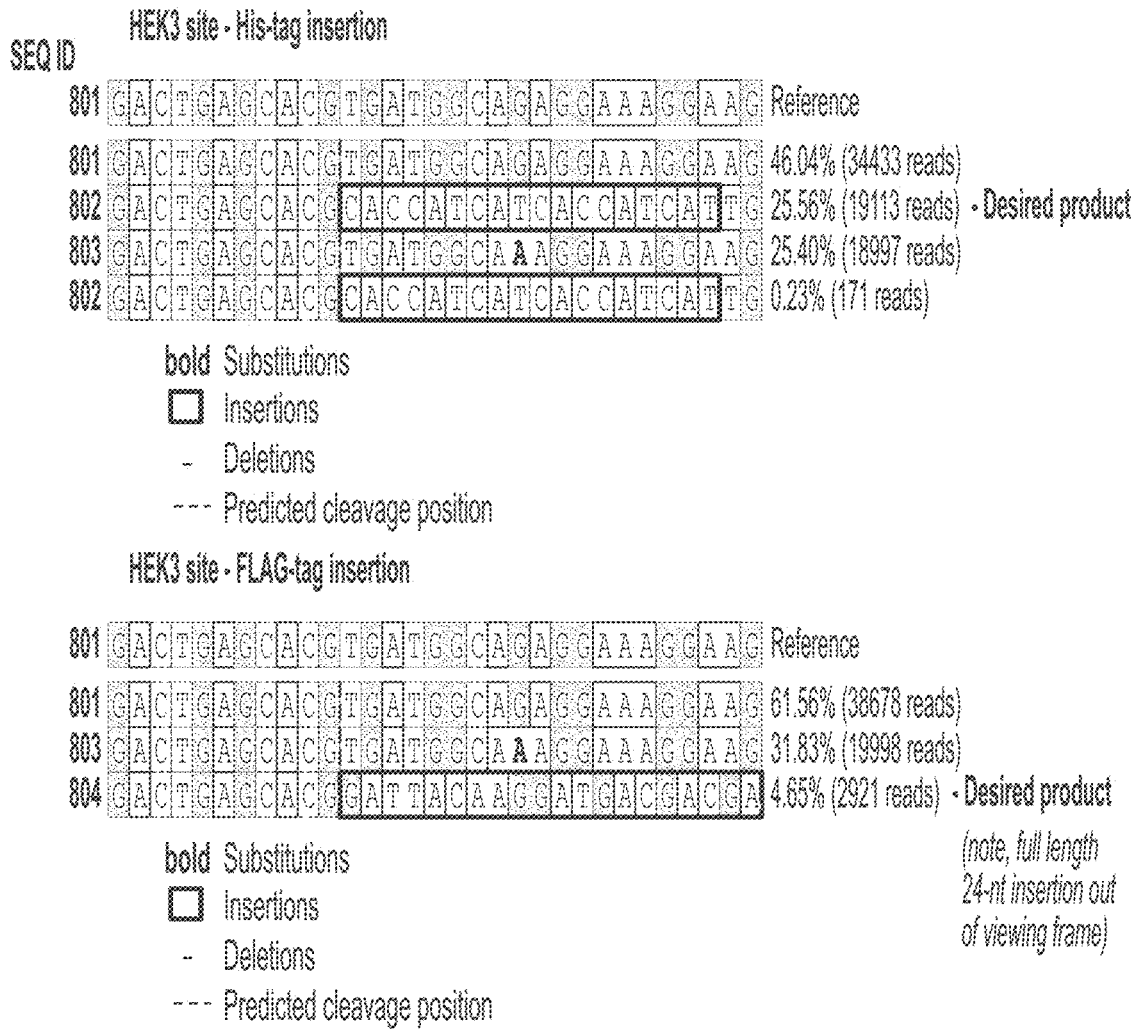
Figure 26B:
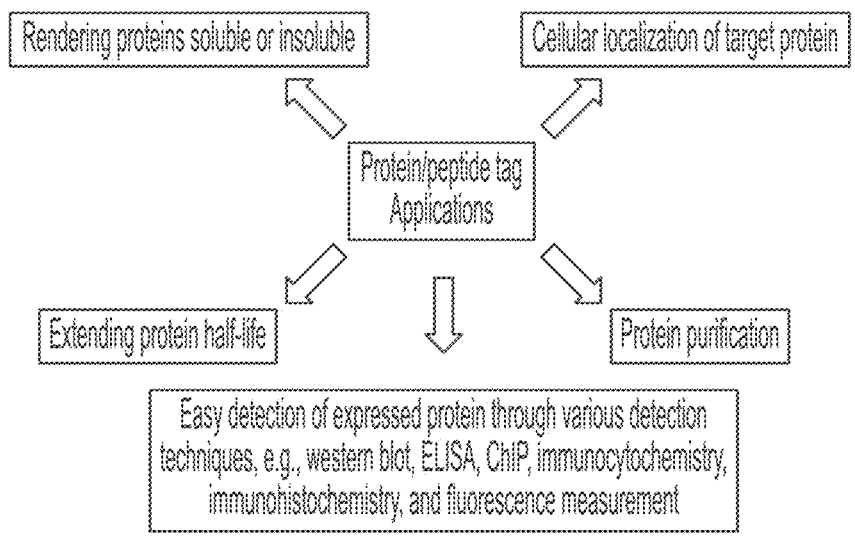

FIG. 26A shows precise installation of a His6-tag and a FLAG-tag into genomic DNA. A guide RNA targeting the HEK3 locus was designed with a reverse transcription template that encodes either an 18-nt His-tag insertion or a 24-nt FLAG-tag insertion. Editing efficiency in transfected HEK cells was assessed using amplicon sequencing. Note that the full 24-nt sequence of the FLAG-tag is outside of the viewing frame (sequencing confirmed full and precise insertion). FIG. 26B shows a schematic outlining various applications involving protein/peptide tagging, including (a) rendering proteins soluble or insoluble, (b) changing or tracking the cellular localization of a protein, (c) extending the half-life of a protein, (d) facilitating protein purification, and (e) facilitating the detection of proteins.

Figure 27:
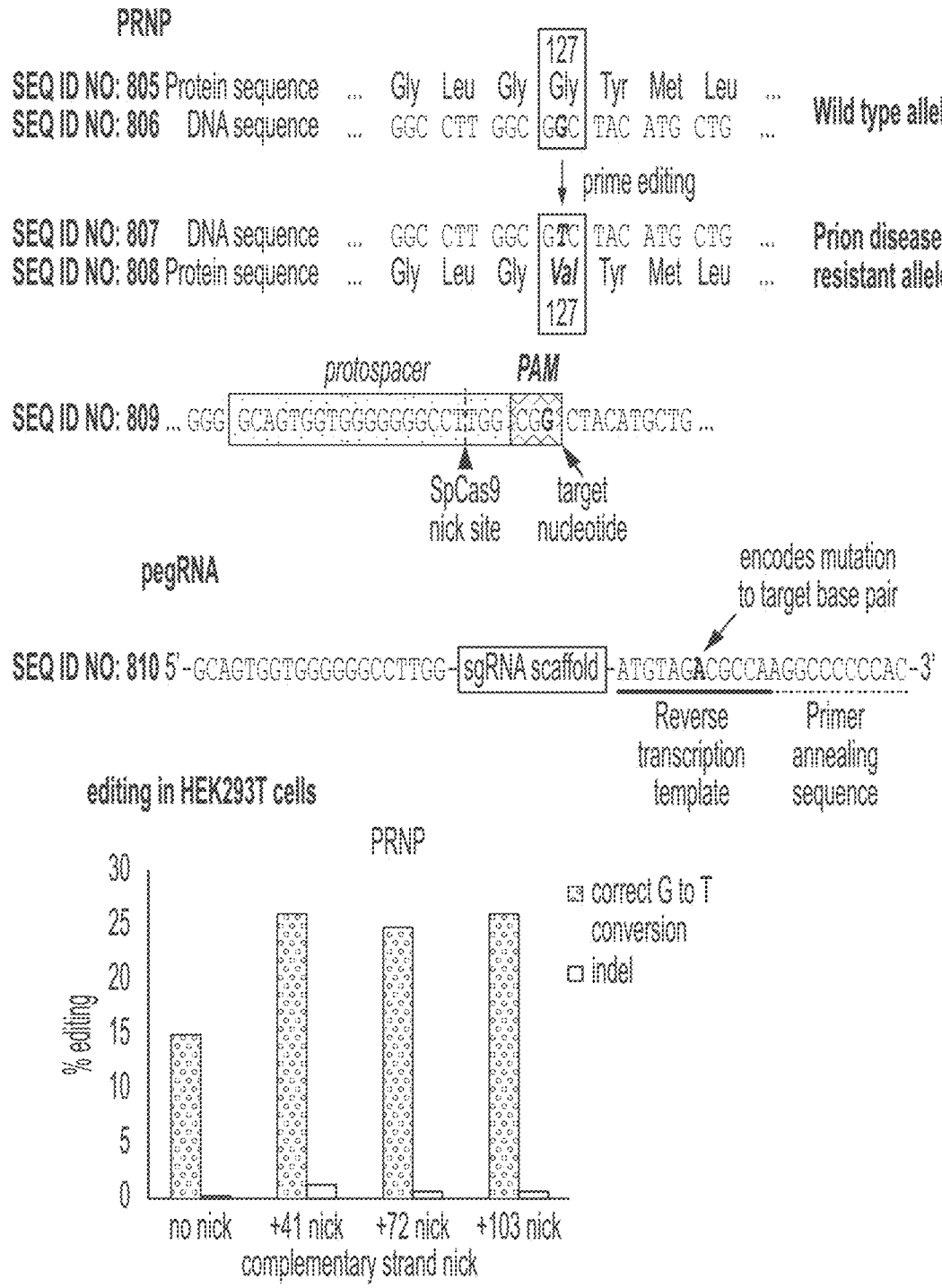

FIG. 27 shows an overview of prime editing by installing a protective mutation in PRNP that prevents or halts the progression of prion disease. The PEgRNA sequences correspond to residue numbers 1-20 of SEQ ID NO: 810 on the left (i.e., 5' of the sgRNA scaffold) and residue numbers 21-43 of SEQ ID NO 810 on the right (i.e., 3' of the sgRNA scaffold).

Figure 28A:
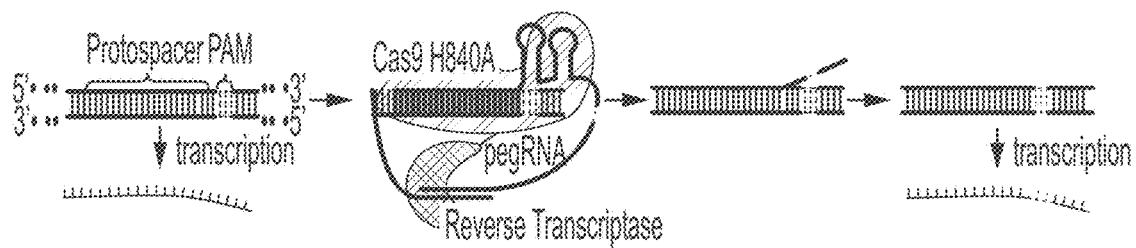

FIG. 28A is a schematic of PE-based insertion of sequences encoding RNA motifs.

Figure 28B:
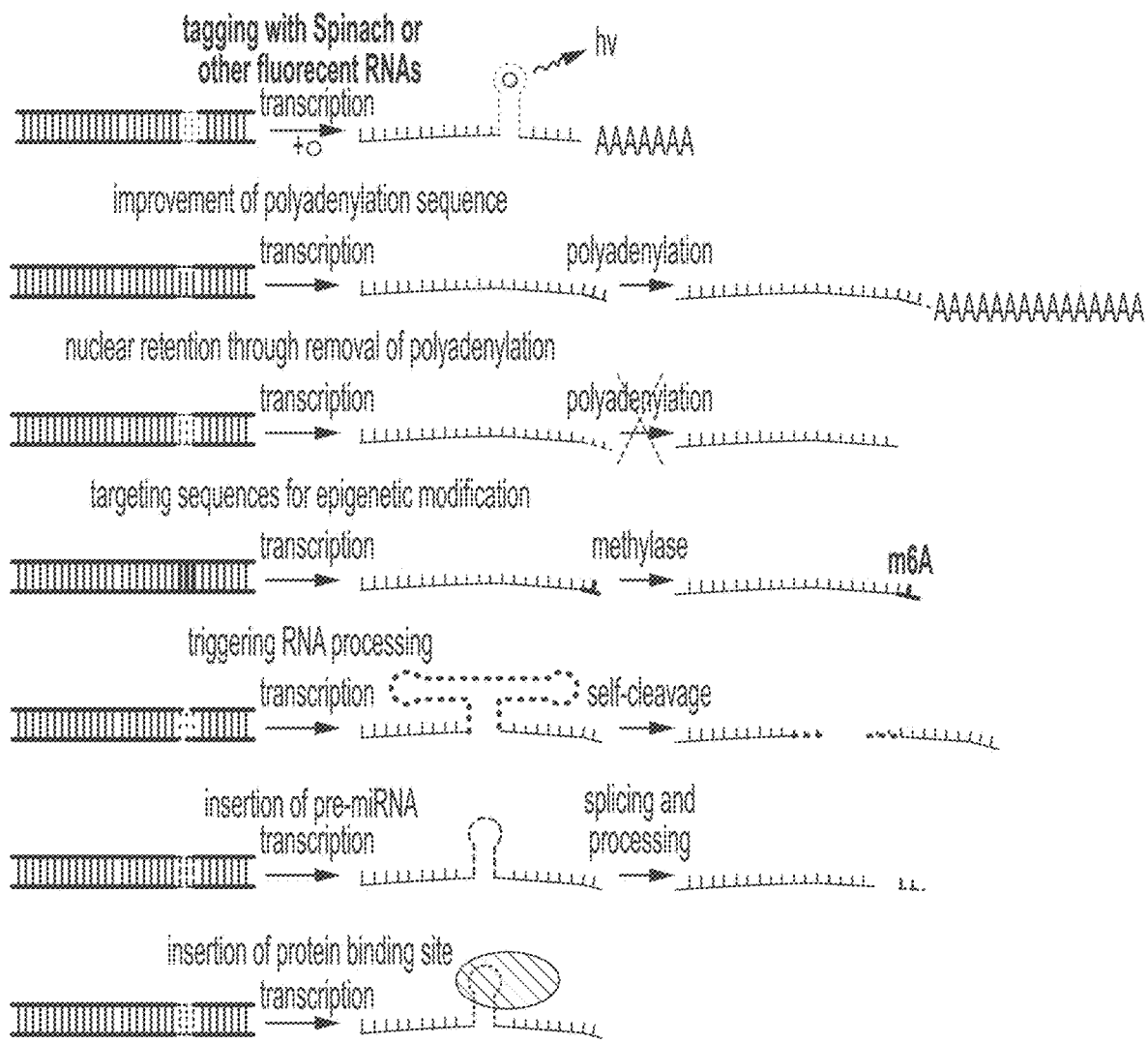

FIG. 28B is a list (not exhaustive) of some example motifs that could potentially be inserted, and their functions.

Figure 29A:
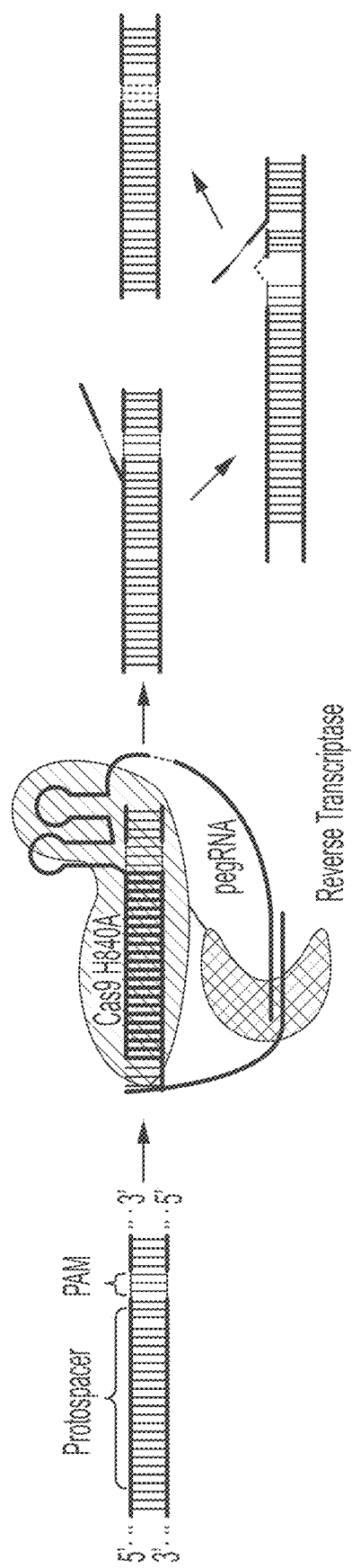
Figure 29B:
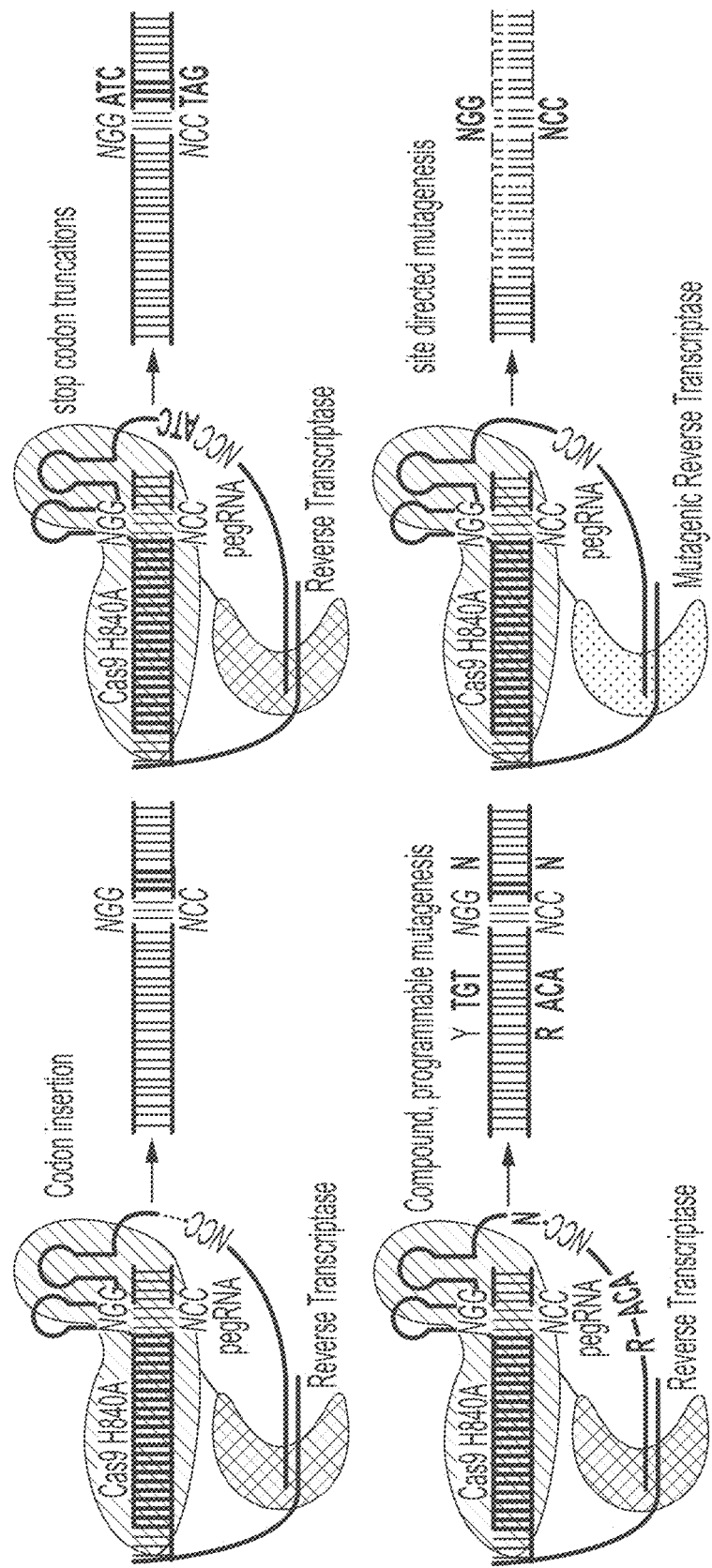
Figure 29C:
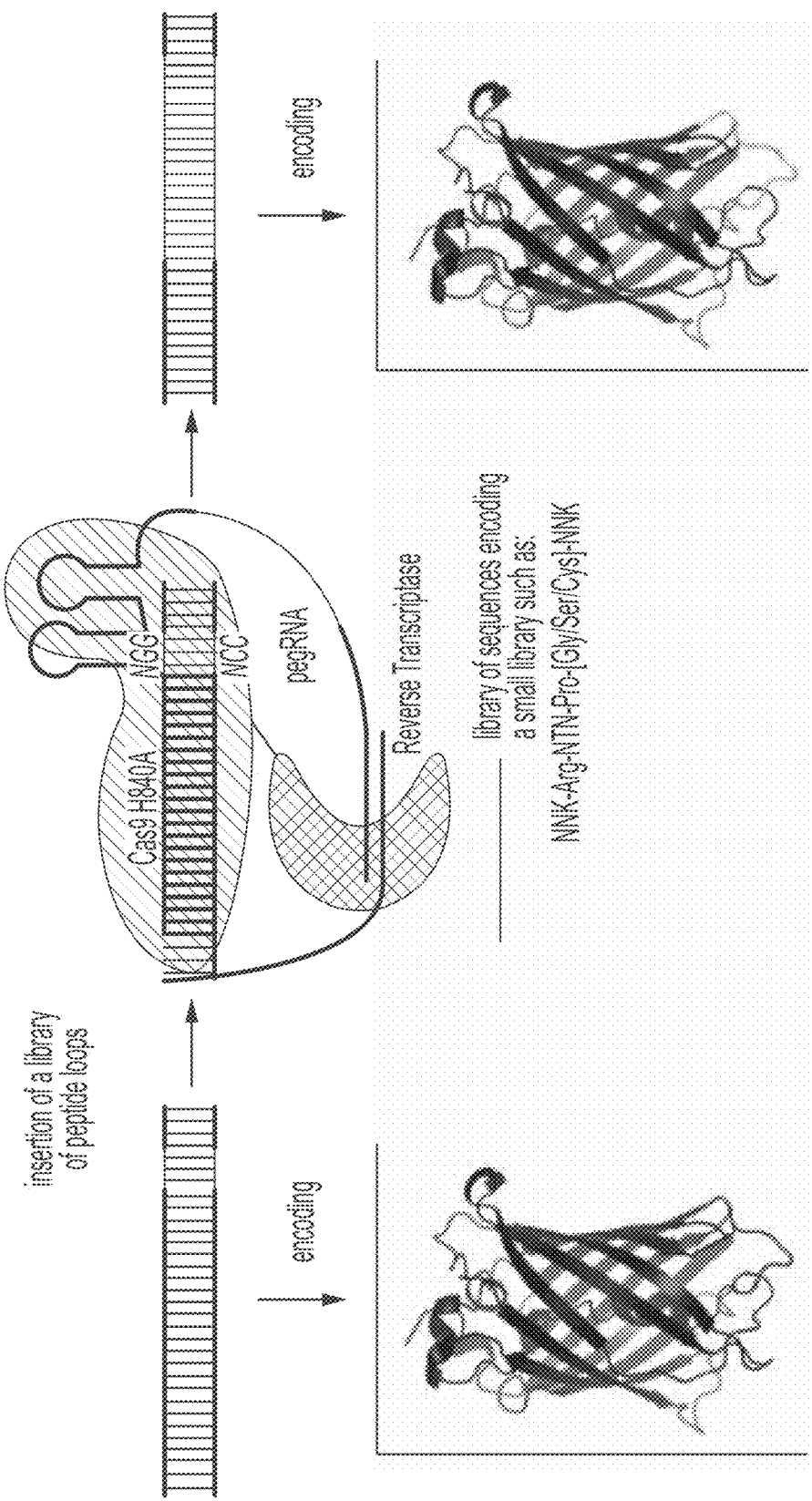

FIG. 29A is a depiction of a prime editor. FIG. 29B shows possible modifications to genomic, plasmid, or viral DNA directed by a PE. FIG. 29C shows an example scheme for insertion of a library of peptide loops into a specified protein (in this case GFP) via a library of PEgRNAs. FIG. 29D shows an example of possible programmable deletions of codons or N-, or C-terminal truncations of a protein using different PEgRNAs. Deletions would be predicted to occur with minimal generation of frameshift mutations.

Figure 30:
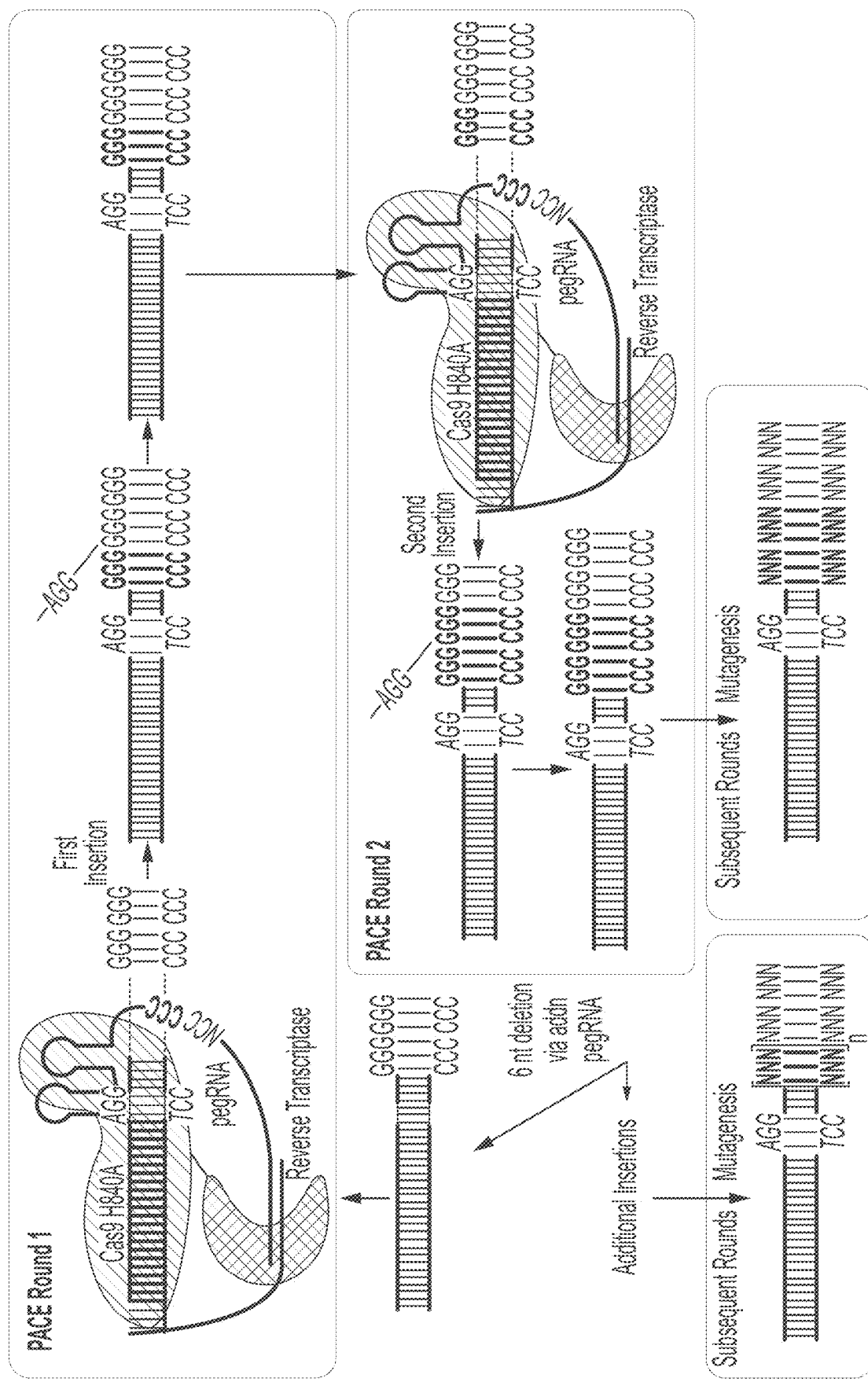

FIG. 30 shows a possible scheme for iterative insertion of codons in a continual evolution system, such as PACE.

Figure 31:
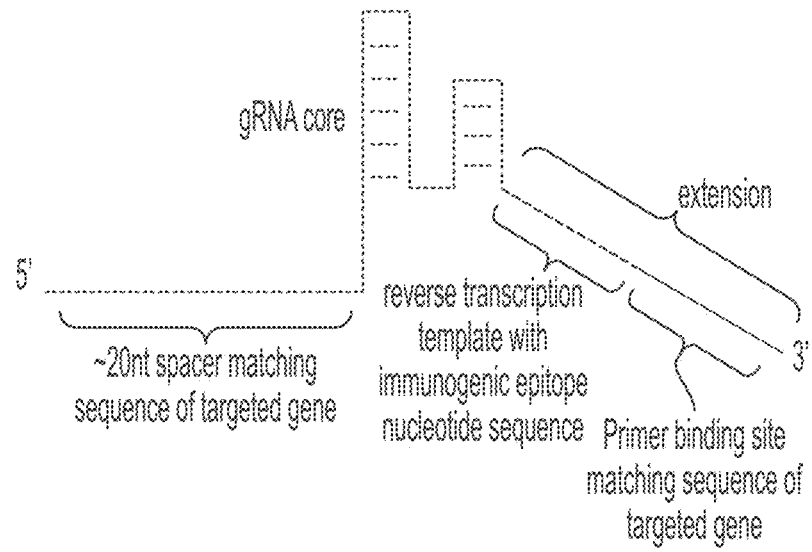

FIG. 31 is an illustration of an engineered gRNA showing the gRNA core, ~20nt spacer matching the sequence of the targeted gene, the reverse transcription template with immunogenic epitope nucleotide sequence and the primer binding site matching the sequence of the targeted gene.

Figure 32:
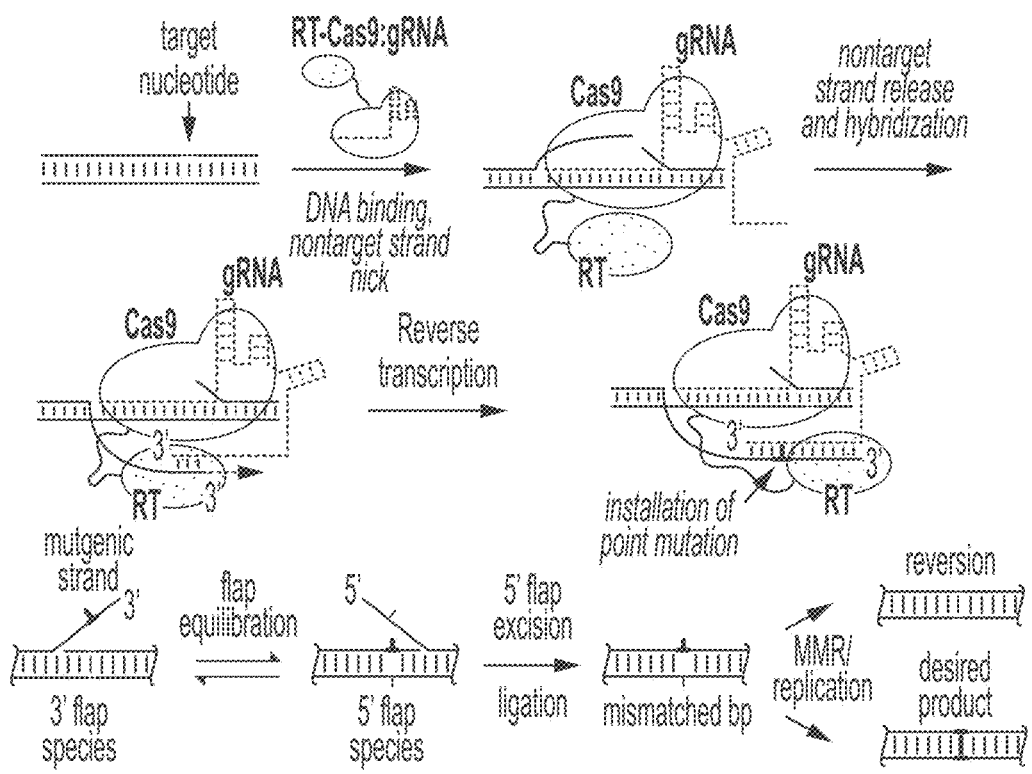

FIG. 32 is a schematic showing using prime editing as a means to insert known immunogenicity epitopes into endogenous or foreign genomic DNA, resulting in modification of the corresponding proteins.

FIG. 33 is a schematic showing PEgRNA design for primer binding sequence insertions and primer binding insertion into genomic DNA using prime editing for determining off-target editing. In this embodiment, prime editing is conducted inside a living cell, a tissue, or an animal model. As a first step, an appropriate PEgRNA is designed. The top schematic shows an exemplary PEgRNA that may be used in this aspect. The spacer in the PEgRNA (labeled "protospacer") is complementary to one of the strands of the genomic target. The PE:PEgRNA complex (i.e., the PE complex) installs a single stranded 3' end flap at the nick site which contains the encoded primer binding sequence and the region of homology (coded by the homology arm of the PEgRNA) that is complementary to the region just downstream of the cut site (in red). Through flap invasion and DNA repair/replication processes, the synthesized strand becomes incorporated into the DNA, thereby installing the primer binding site. This process can occur at the desired genomic target, but also at other genomic sites that might interact with the PEgRNA in an off-target manner (i.e., the PEgRNA guides the PE complex to other off-target sites due to the complementarity of the spacer region to other genomic sites that are not the intended genomic site). Thus, the primer binding sequence may be installed not only at the desired genomic target, but at off-target genomic sites elsewhere in the genome. In order to detect the insertion of these primer binding sites at both the intended genomic target sites and the off-target genomic sites, the genomic DNA (post-PE) can be isolated, fragmented, and ligated to adapter nucleotides (shown in red). Next, PCR may be carried out with PCR oligonucleotides that anneal to the adapters and to the inserted primer binding sequence to amplify on-target and off-target genomic DNA regions into which the primer binding site was inserted by PE. High throughput sequencing then me be conducted to and sequence alignments to identify the insertion points of PE-inserted primer binding sequences at either the on-target site or at off-target sites.

Figure 34:
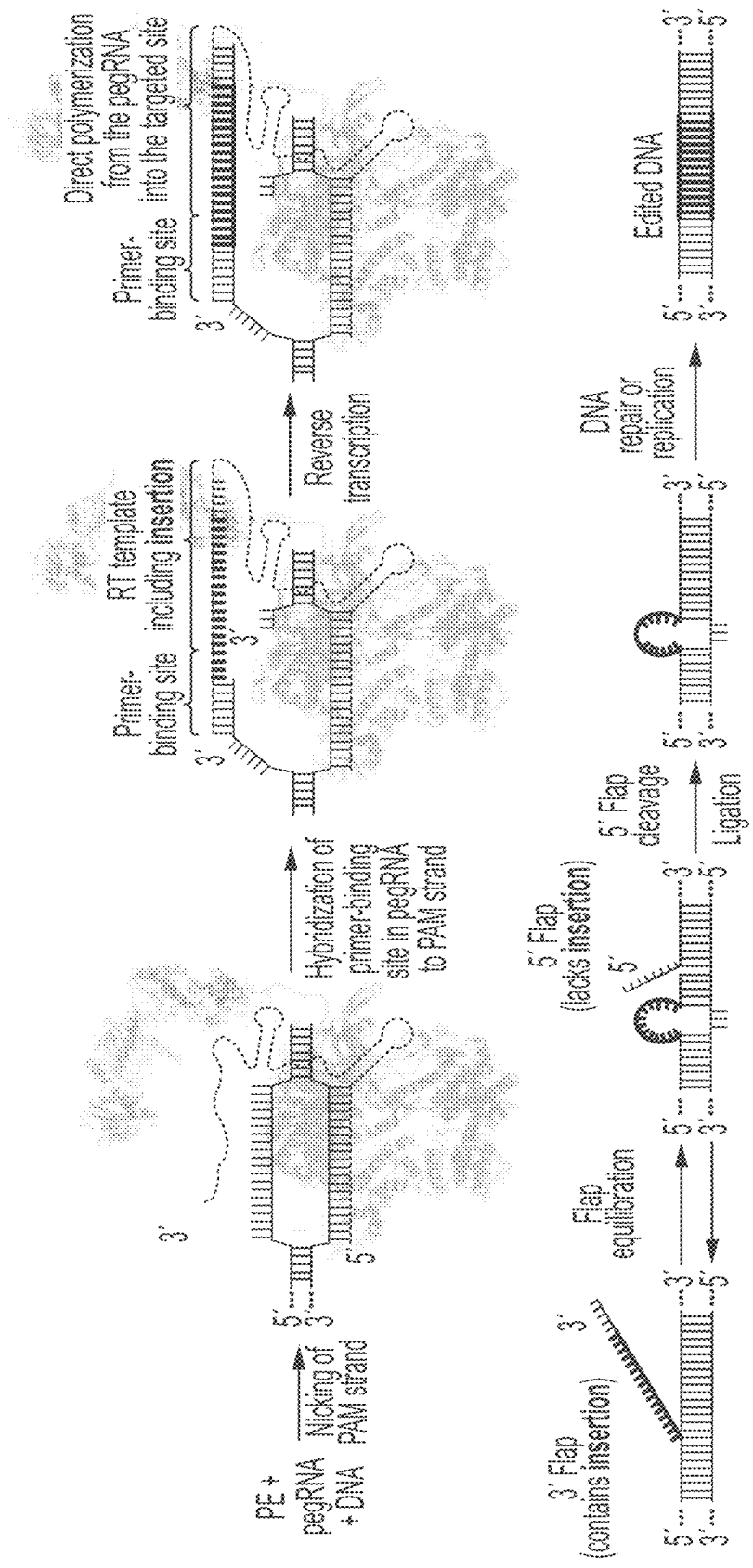

FIG. 34 is a schematic showing the precise insertion of a gene with PE.

Figure 35A:
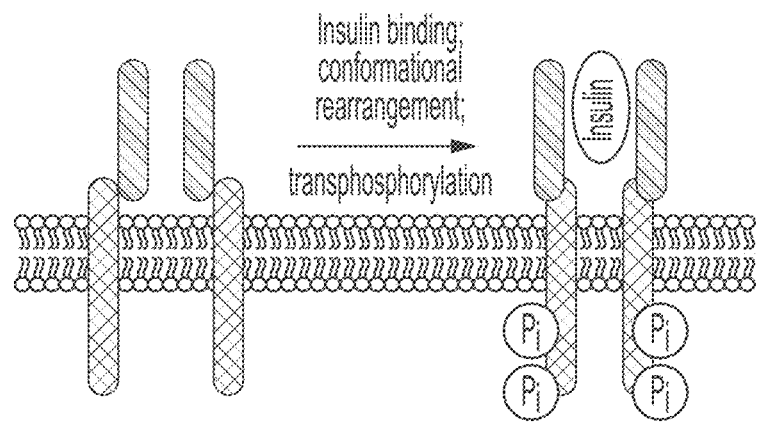
Figure 35B:
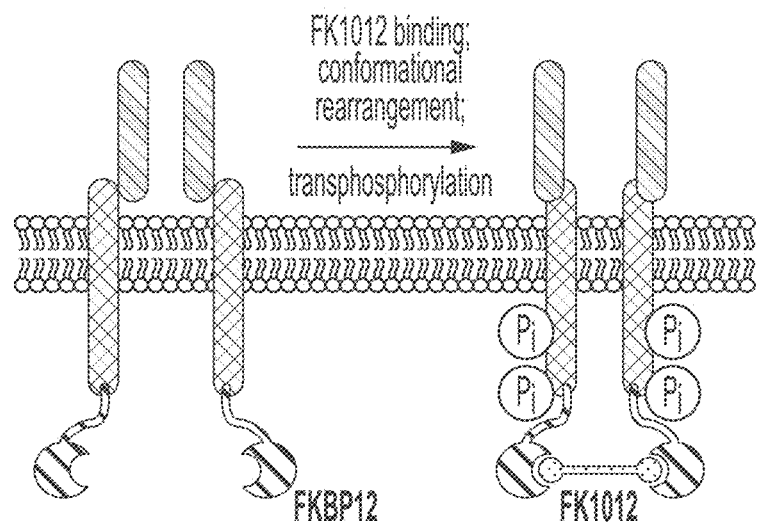

FIG. 35A is a schematic showing the natural insulin signaling pathway. FIG. 35B is a schematic showing FKBP12-tagged insulin receptor activation controlled by FK1012.

Figure 36:
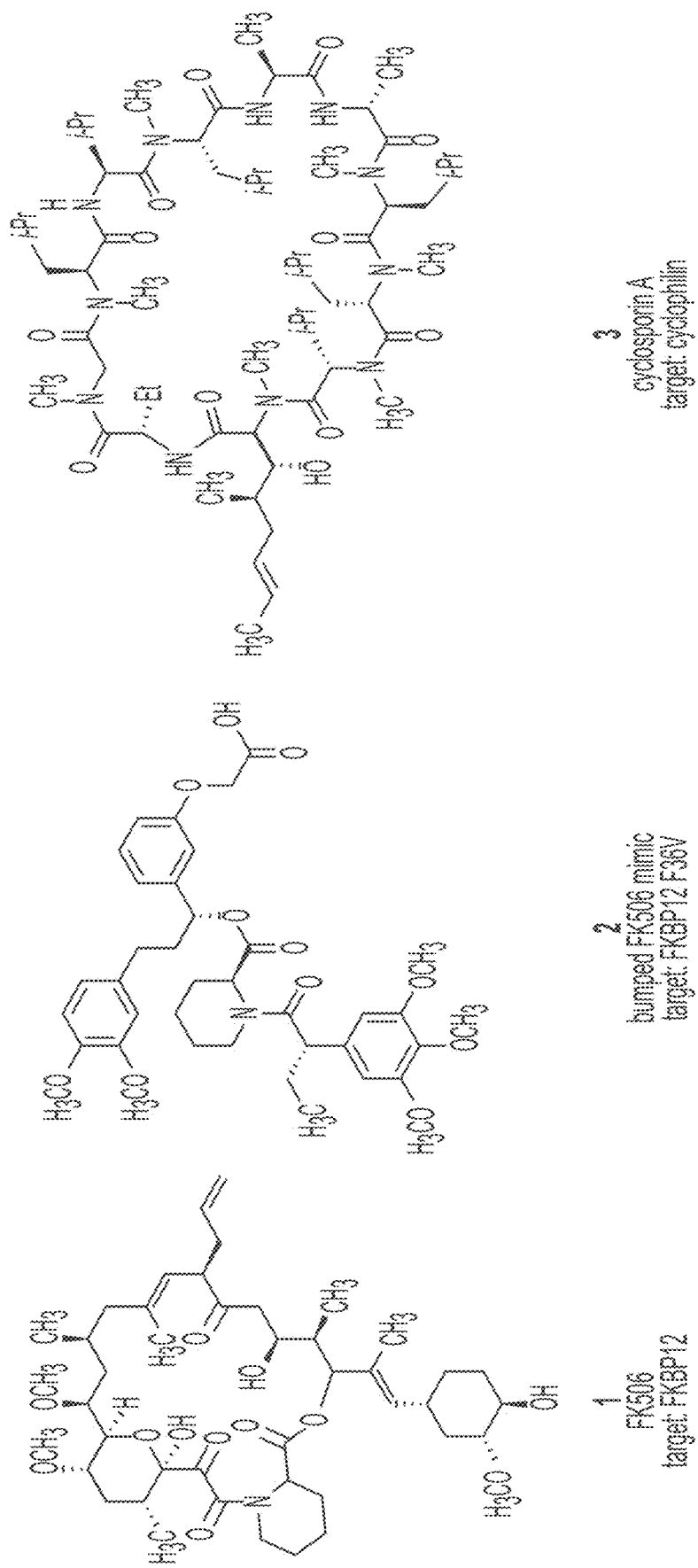

FIG. 36 shows small-molecule monomers. References: bumped FK506 mimic (2)[107]

Figure 37A:
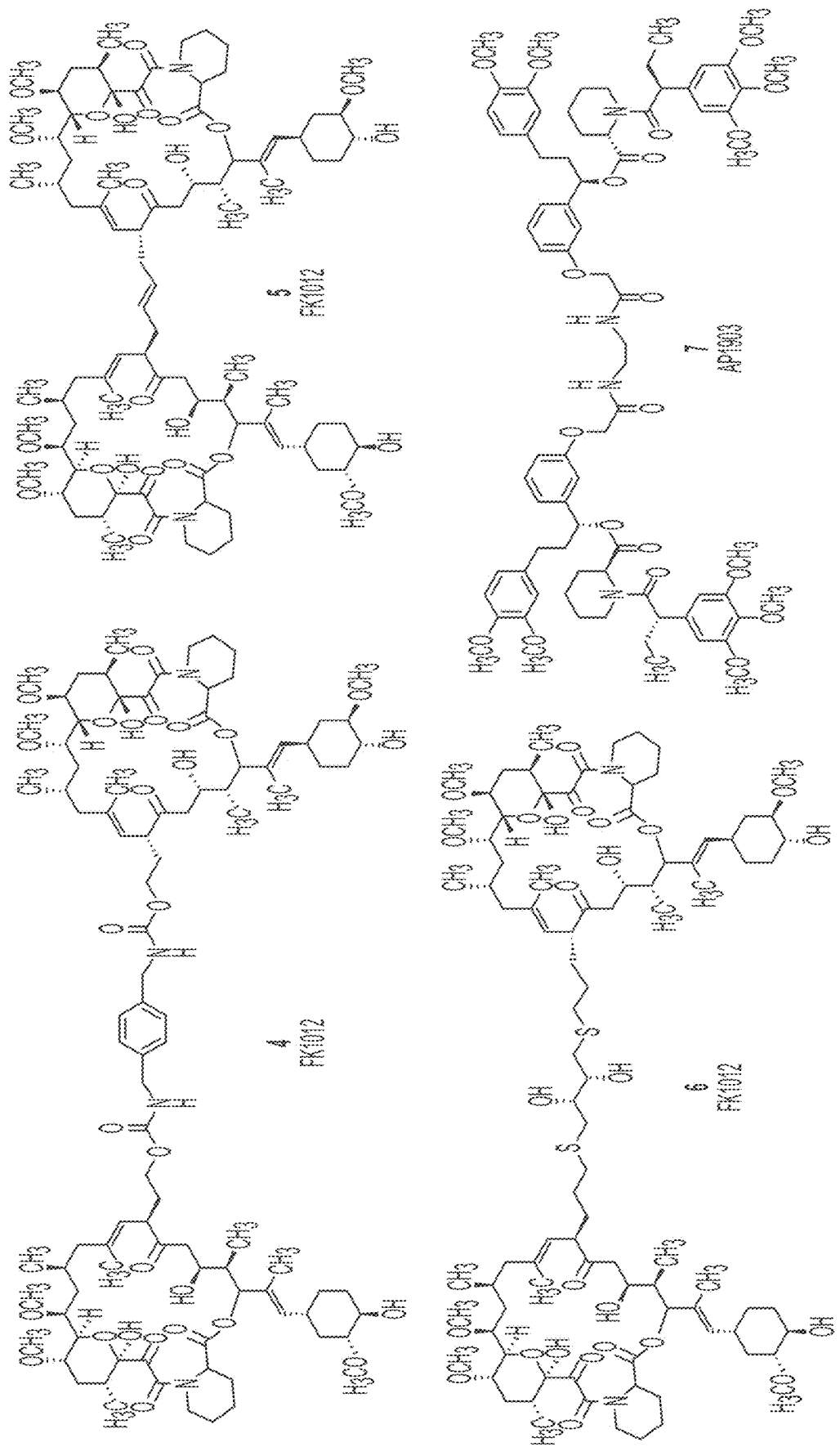
Figure 37B:
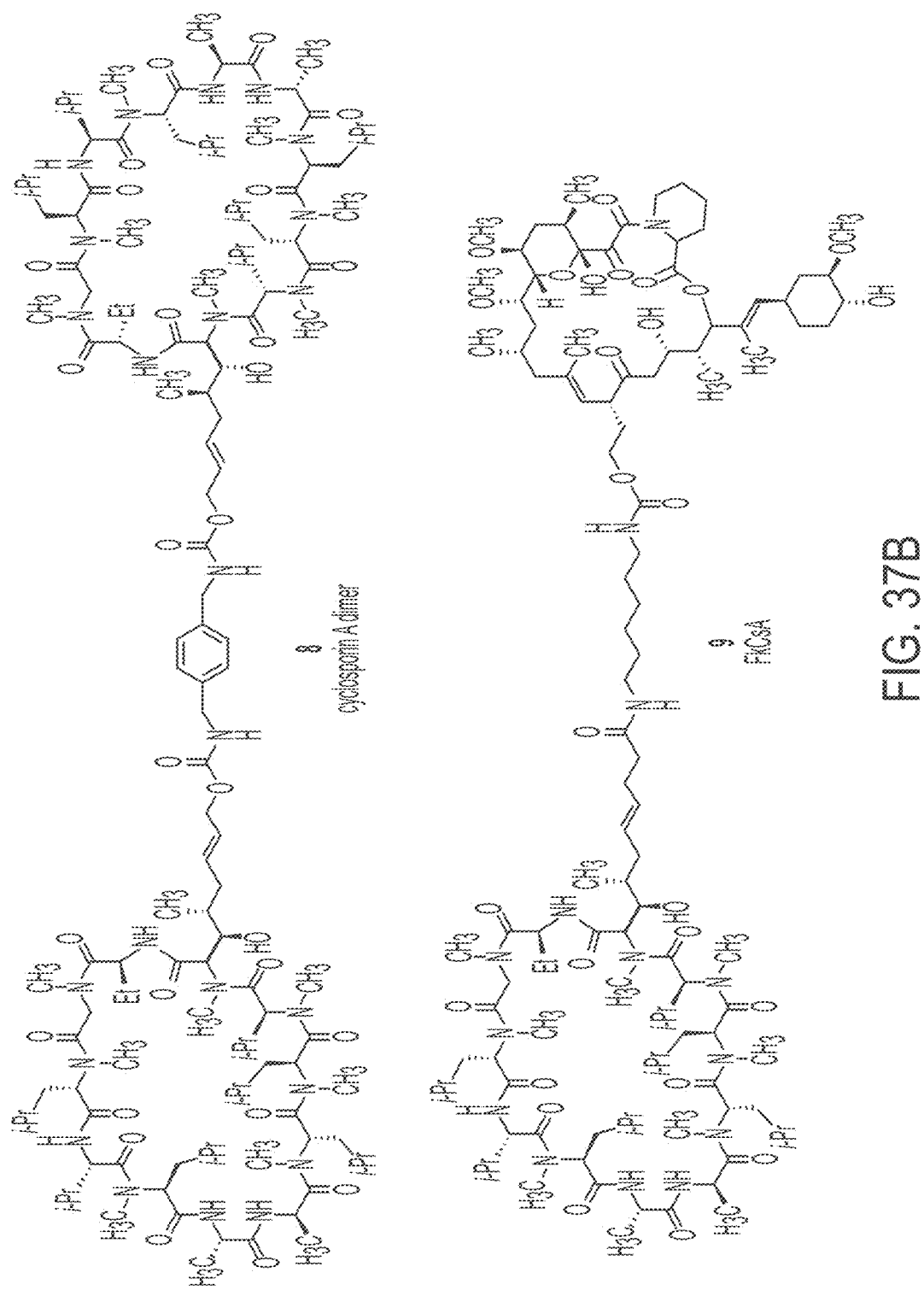

FIGS. 37A-37B show small-molecule dimers. References: FK1012 4[95,96]; FK1012 5[108]; FK1012 6[107]; AP1903 7[107]; cyclosporin A dimer 8[98]; FK506-cyclosporin A dimer (FkCsA) 9[100].

Figure 38A:
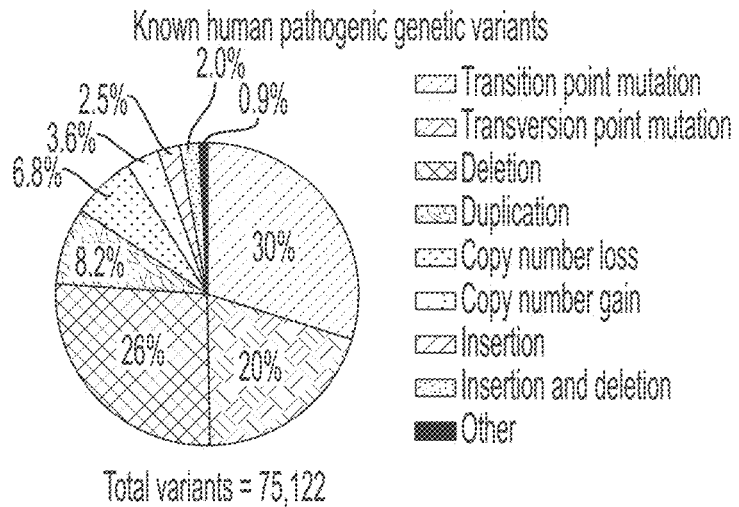
Figure 38B:
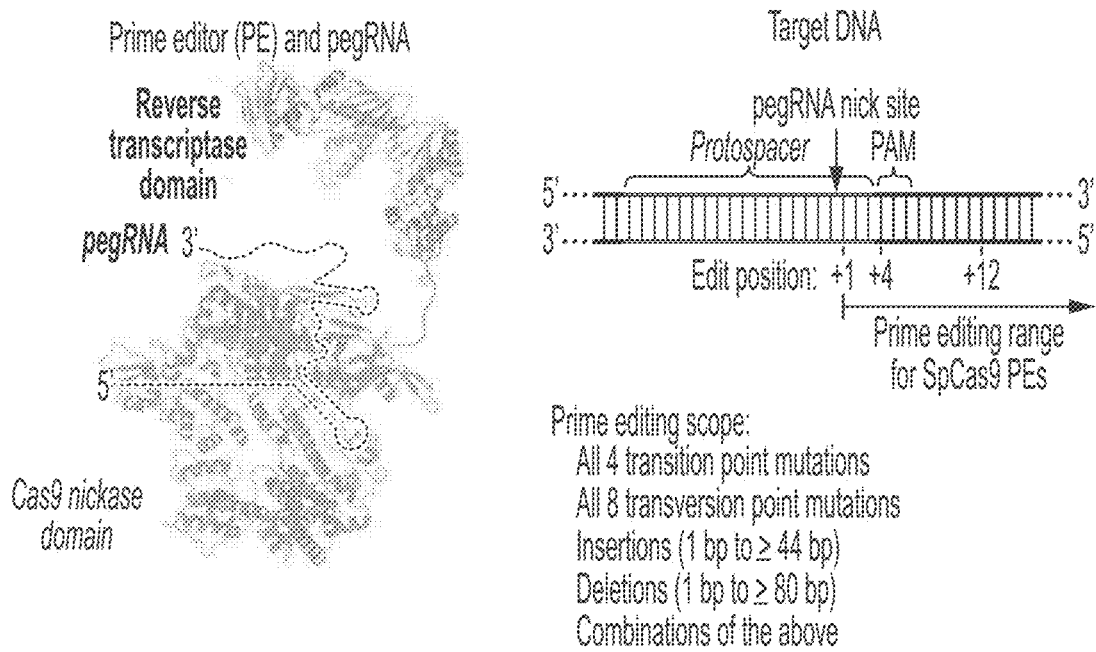
Figure 38C:
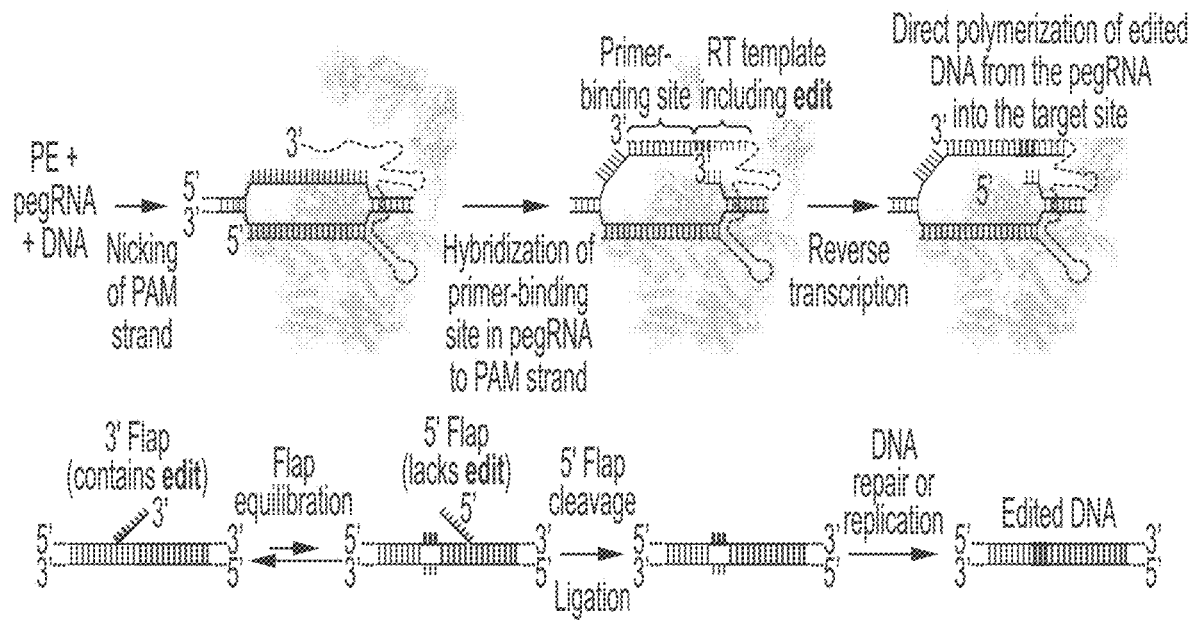
Figure 38D:
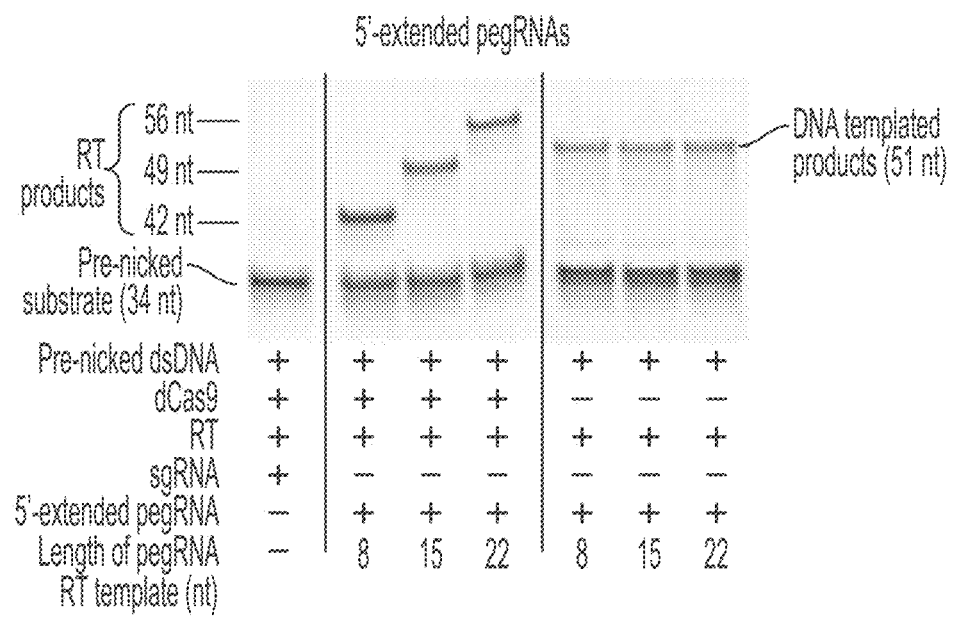
Figure 38E:
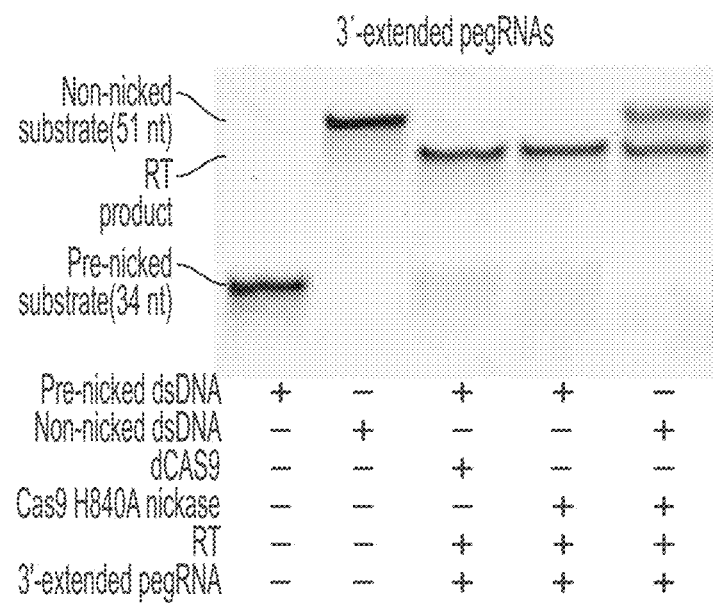
Figure 38F:
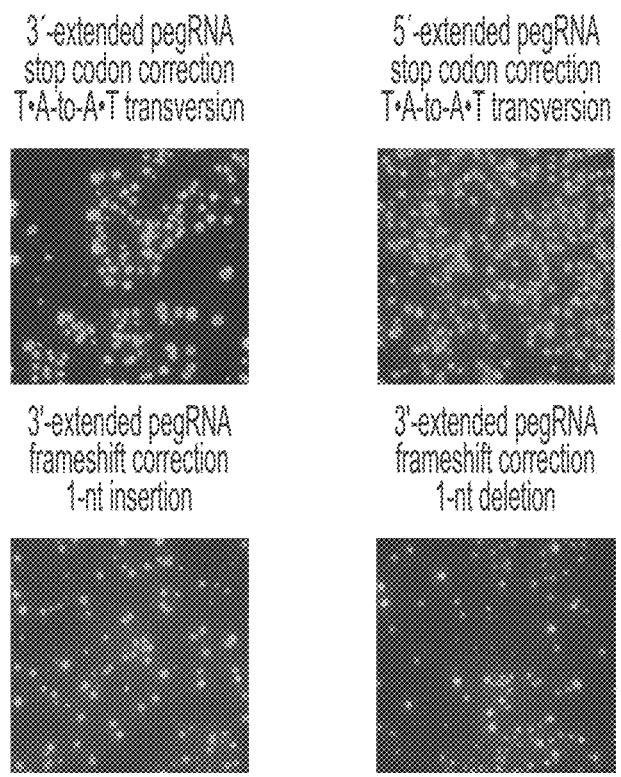

FIGS. 38A-38F provide an overview of prime editing and feasibility studies in vitro and in yeast cells. FIG. 38A shows the 75,122 known pathogenic human genetic variants in ClinVar (accessed July, 2019), classified by type. FIG. 38B shows that a prime editing complex consists of a prime editor (PE) protein containing an RNA-guided DNA-nicking domain, such as Cas9 nickase, fused to an engineered reverse transcriptase domain and complexed with a prime editing guide RNA (PEgRNA). The PE:PEgRNA complex binds the target DNA site and enables a large variety of precise DNA edits at a wide range of DNA positions before or after the target site's protospacer adjacent motif (PAM). FIG. 38C shows that upon DNA target binding, the PE:PEgRNA complex nicks the PAM-containing DNA strand. The resulting free 3' end hybridizes to the primer-binding site of the PEgRNA. The reverse transcriptase domain catalyzes primer extension using the RT template of the PEgRNA, resulting in a newly synthesized DNA strand containing the desired edit (the 3' flap). Equilibration between the edited 3' flap and the unedited 5' flap containing the original DNA, followed by cellular 5' flap cleavage and ligation, and DNA repair or replication to resolve the heteroduplex DNA, results in stably edited DNA. FIG. 38D shows in vitro 5'-extended PEgRNA primer extension assays with pre-nicked dsDNA substrates containing 5'-Cy5 labeled PAM strands, dCas9, and a commercial M-MLV RT variant (RT, Superscript III). dCas9 was complexed with PEgRNAs containing RT template of varying lengths, then added to DNA substrates along with the indicated components. Reactions were incubated at 37° C. for 1 hour, then analyzed by denaturing urea PAGE and visualized for Cy5 fluorescence. FIG. 38E shows primer extension assays performed as in FIG. 38D using 3'-extended PEgRNAs pre-complexed with dCas9 or Cas9 H840A nickase, and pre-nicked or non-nicked 5'-Cy5-labeled dsDNA substrates. FIG. 38F shows yeast colonies transformed with GFP-mCherry fusion reporter plasmids edited in vitro with PEgRNAs, Cas9 nickase, and RT. Plasmids containing nonsense or frameshift mutations between GFP and mCherry were edited with 5'-extended or 3'-extended PEgRNAs that restore mCherry translation via transversion mutation, 1-bp insertion, or 1-bp deletion. GFP and mCherry double-positive cells (yellow) reflect successful editing.

Figure 39C:
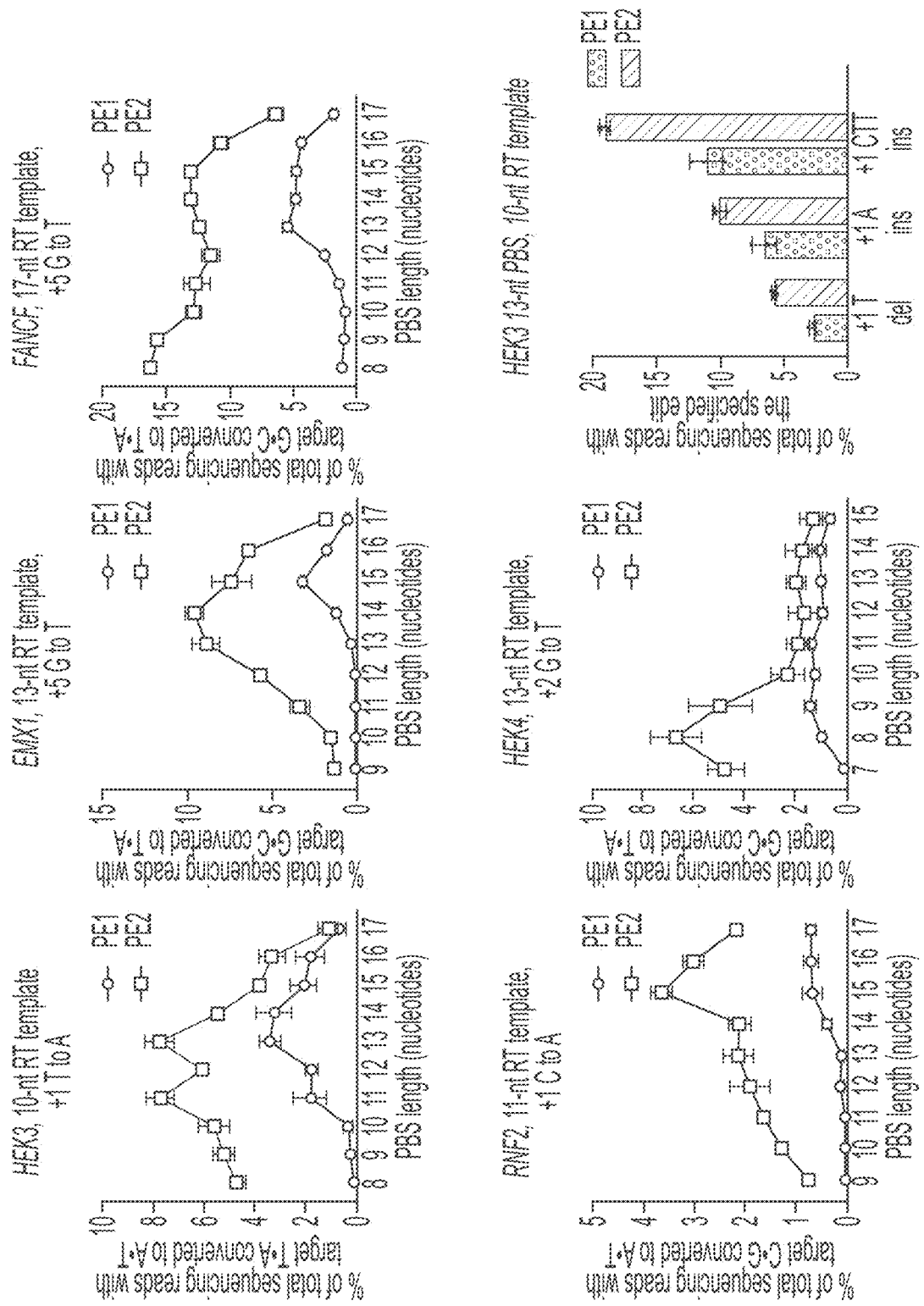
Figure 39D:
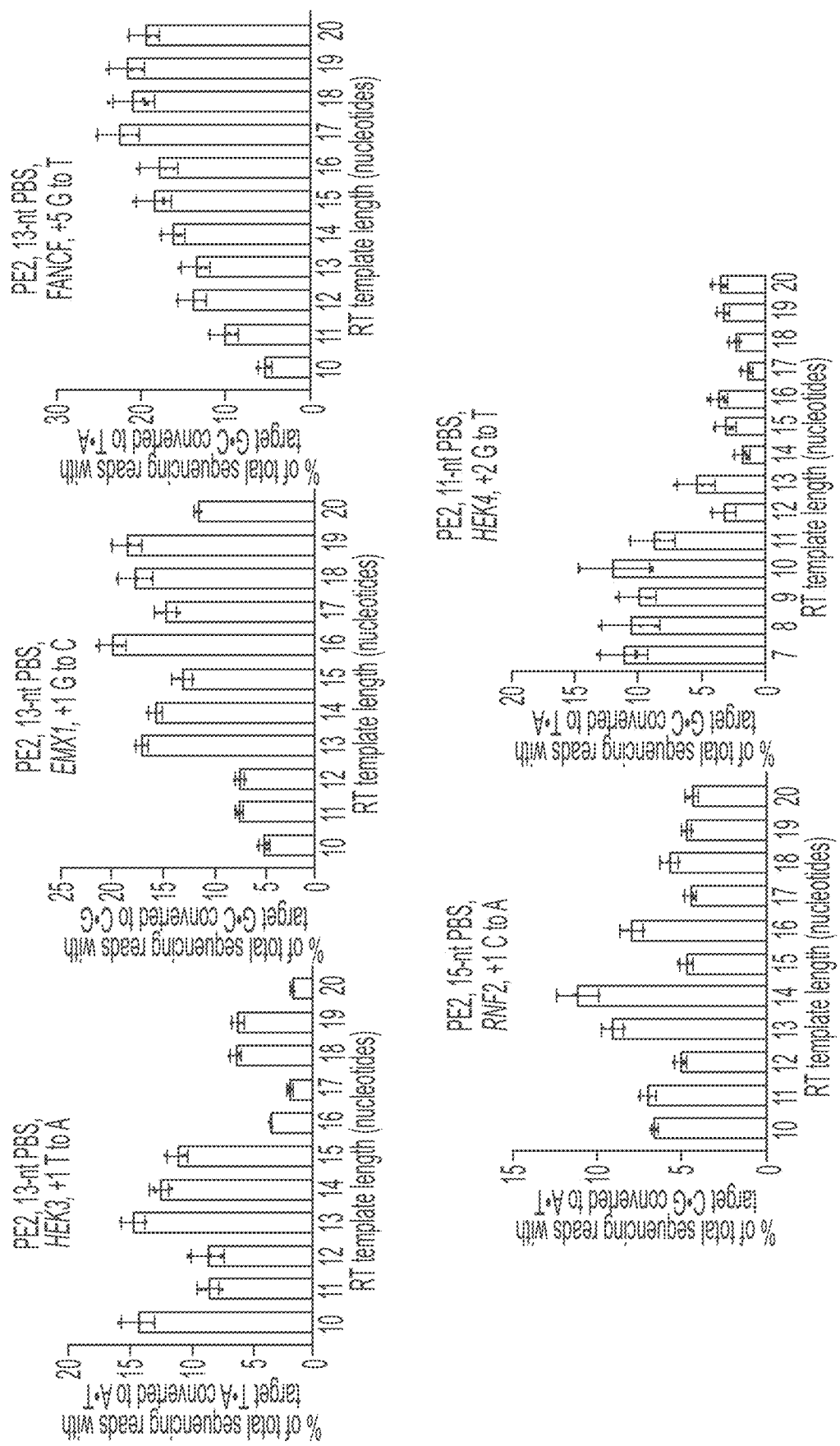

FIGS. 39A-39D show prime editing of genomic DNA in human cells by PE1 and PE2. FIG. 39A shows PEgRNAs contain a spacer sequence, a sgRNA scaffold, and a 3' extension containing a primer-binding site (green) and a reverse transcription (RT) template (purple), which contains the edited base(s) (red). The primer-binding site hybridizes to the PAM-containing DNA strand immediately upstream of the site of nicking. The RT template is homologous to the DNA sequence downstream of the nick, with the exception of the encoded edit. FIG. 39B shows an installation of a T.A-to-A.T transversion edit at the HEK3 site in HEK293T cells using Cas9 H840A nickase fused to wild-type M-MLV reverse transcriptase (PE1) and PEgRNAs of varying primer-binding site lengths. FIG. 39C shows the use of an engineered pentamutant M-MLV reverse transcriptase (D200N, L603W, T306K, W313F, T330P) in PE2 substantially improves prime editing transversion efficiencies at five genomic sites in HEK293T cells, and small insertion and small deletion edits at HEK3. FIG. 39D is a comparison of PE2 editing efficiencies with varying RT template lengths at five genomic sites in HEK293T cells. Values and error bars reflect the mean and s.d. of three independent biological replicates.

Figure 40A:
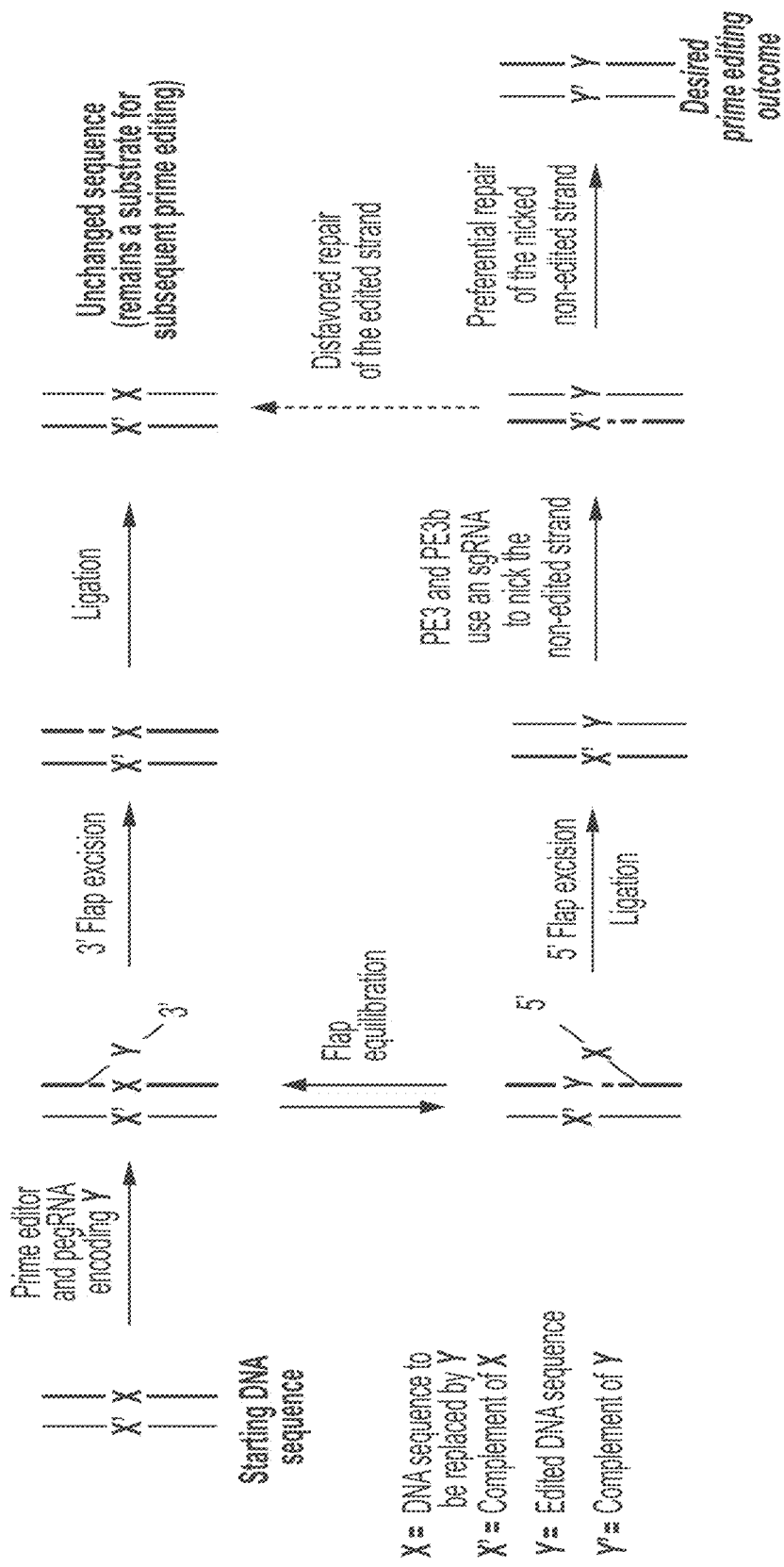
Figure 40B:
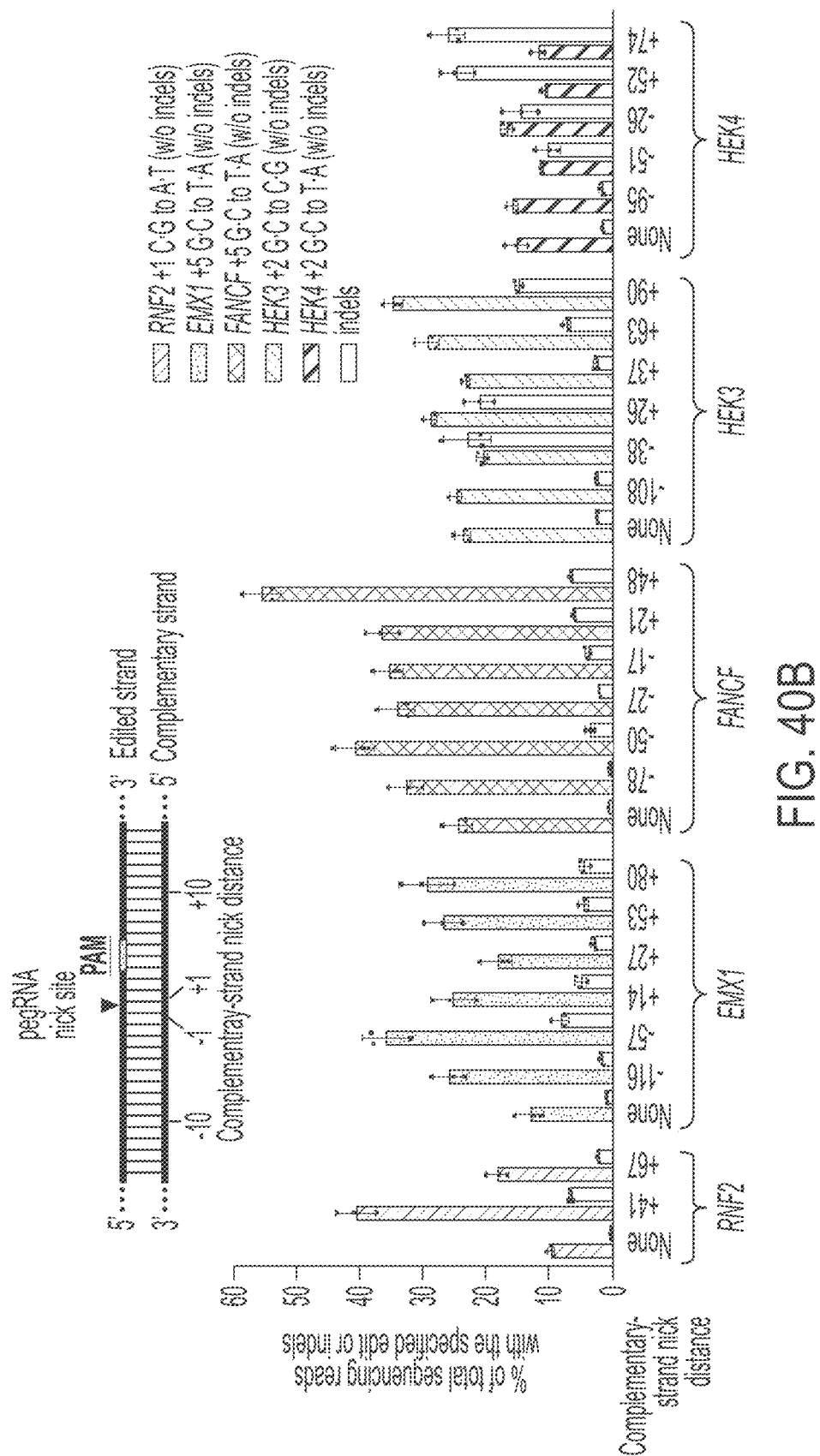
Figure 40C:
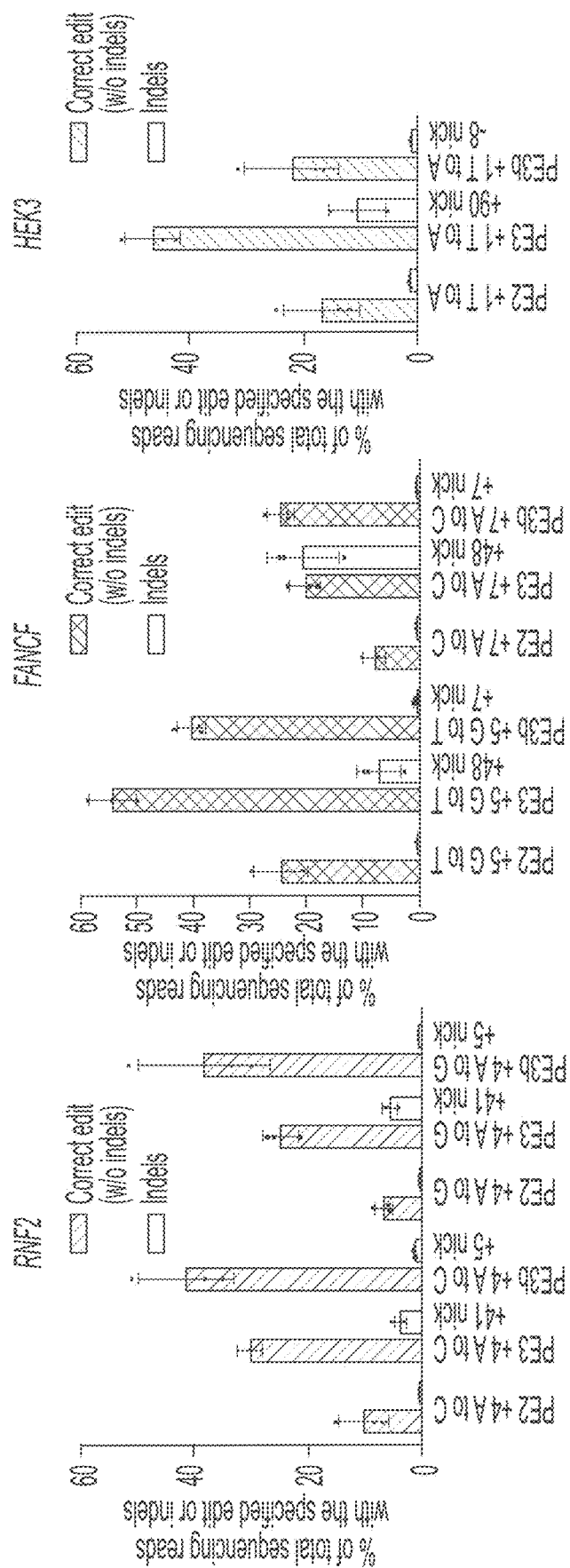

FIGS. 40A-40C show PE3 and PE3b systems nick the non-edited strand to increase prime editing efficiency. FIG. 40A is an overview of the prime editing by PE3. After initial synthesis of the edited strand, DNA repair will remove either the newly synthesized strand containing the edit (3' flap excision) or the original genomic DNA strand (5' flap excision). 5' flap excision leaves behind a DNA heteroduplex containing one edited strand and one non-edited strand. Mismatch repair machinery or DNA replication could resolve the heteroduplex to give either edited or non-edited products. Nicking the non-edited strand favors repair of that strand, resulting in preferential generation of stable duplex DNA containing the desired edit. FIG. 40B shows the effect of complementary strand nicking on PE3-mediated prime editing efficiency and indel formation. "None" refers to PE2 controls, which do not nick the complementary strand. FIG. 40C is a comparison of editing efficiencies with PE2 (no complementary strand nick), PE3 (general complementary strand nick), and PE3b (edit-specific complementary strand nick). All editing yields reflect the percentage of total sequencing reads that contain the intended edit and do not contain indels among all treated cells, with no sorting. Values and error bars reflect the mean and s.d. of three independent biological replicates.

Figure 41A:
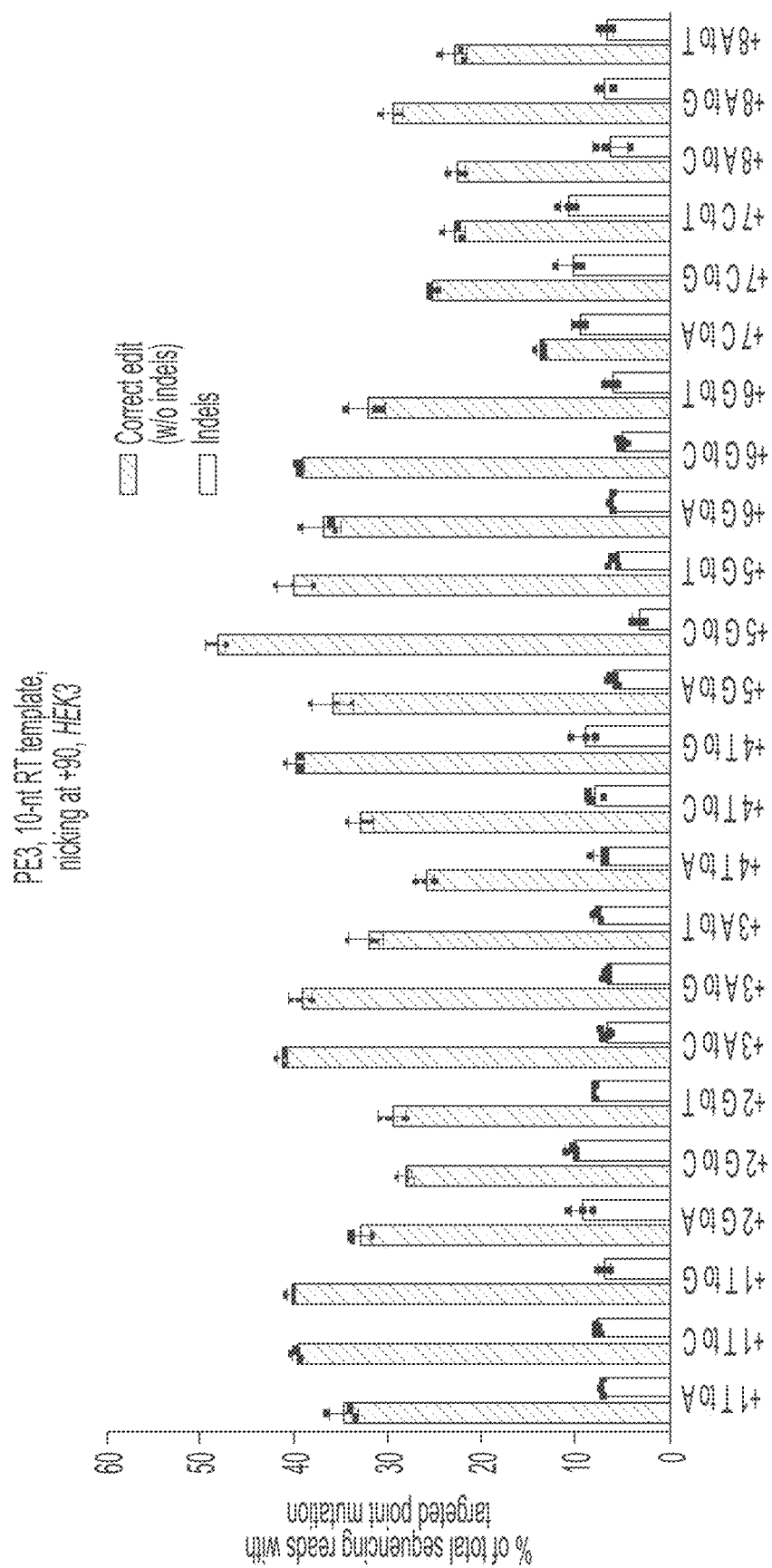
Figure 41C:
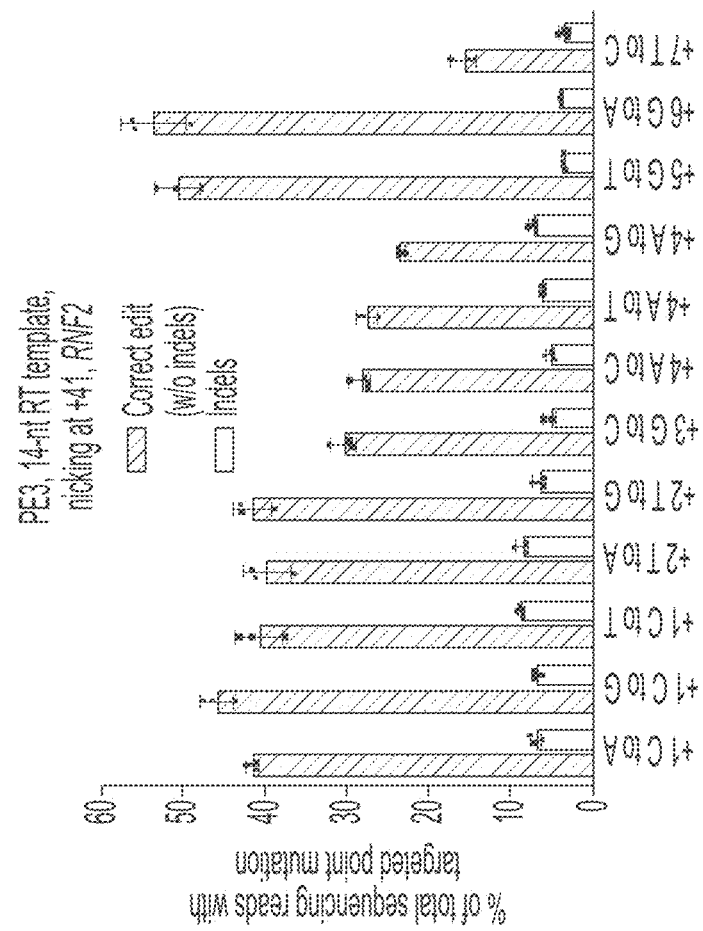
Figure 41B:
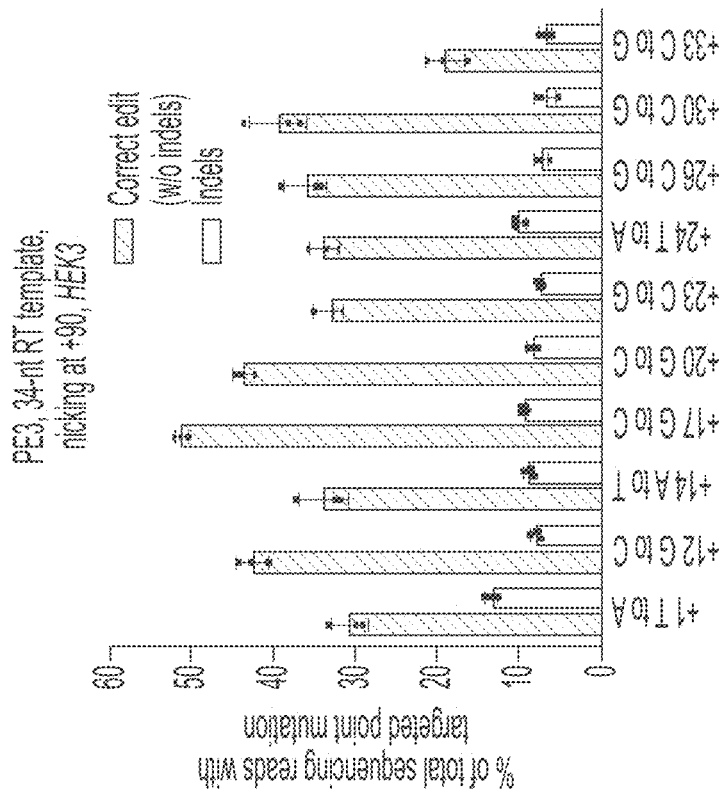
Figure 41E:
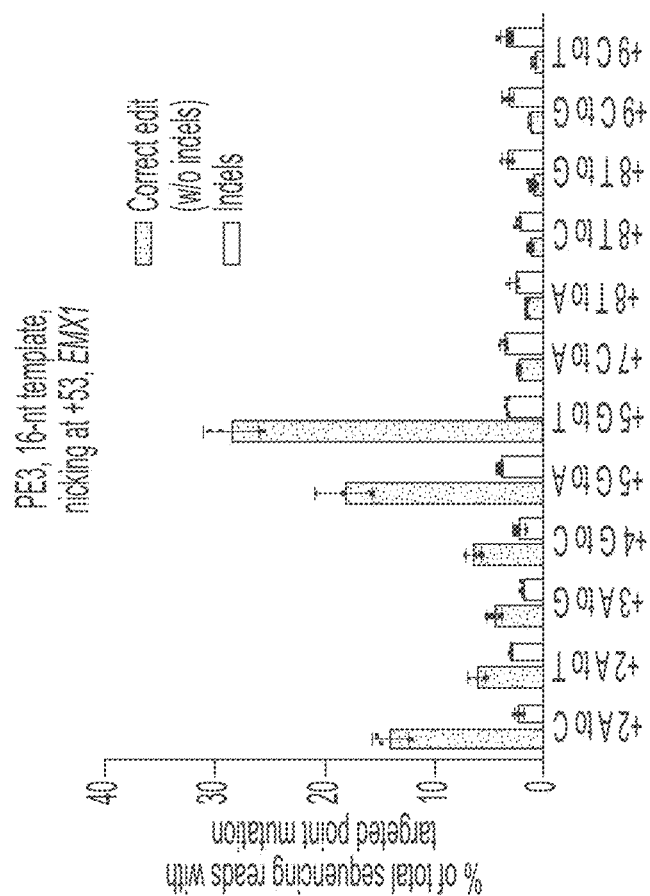
Figure 41D:
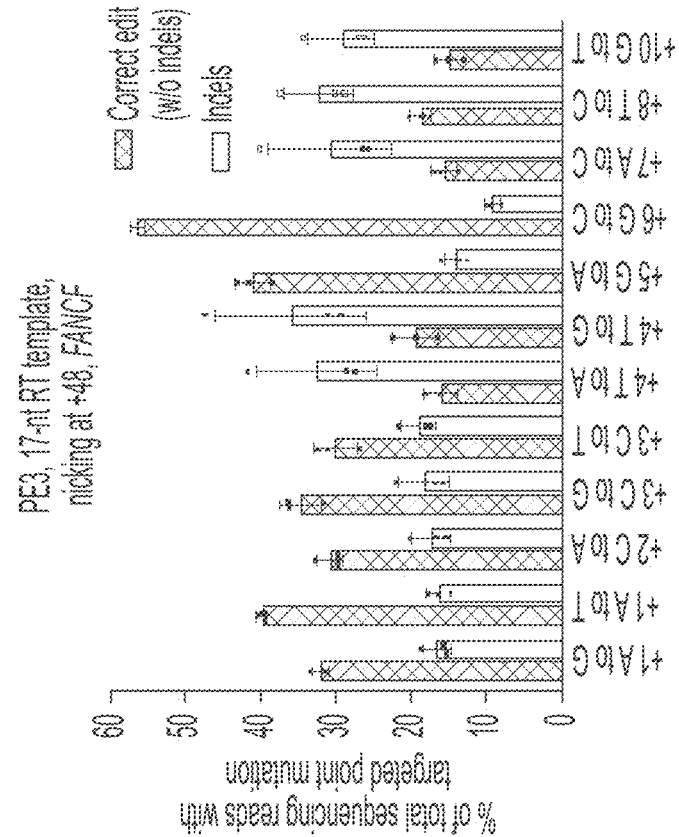
Figure 41G:
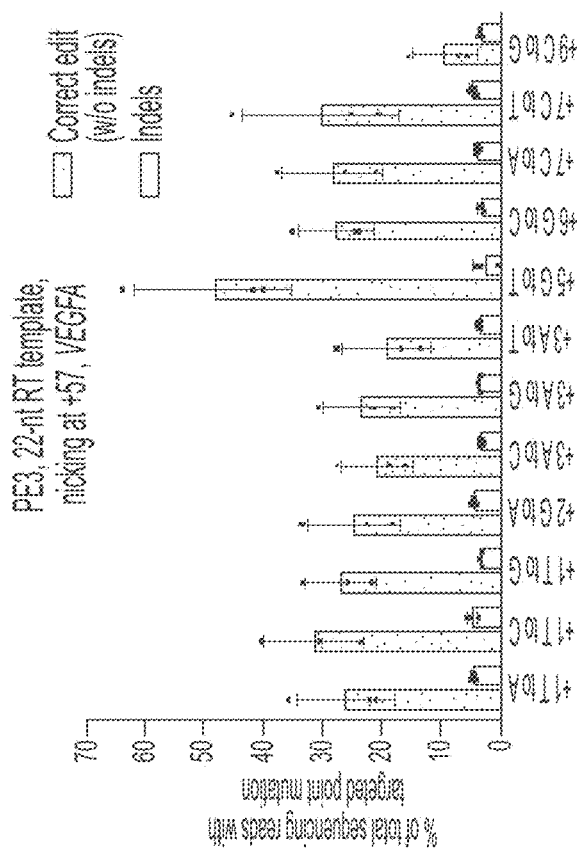
Figure 41F:
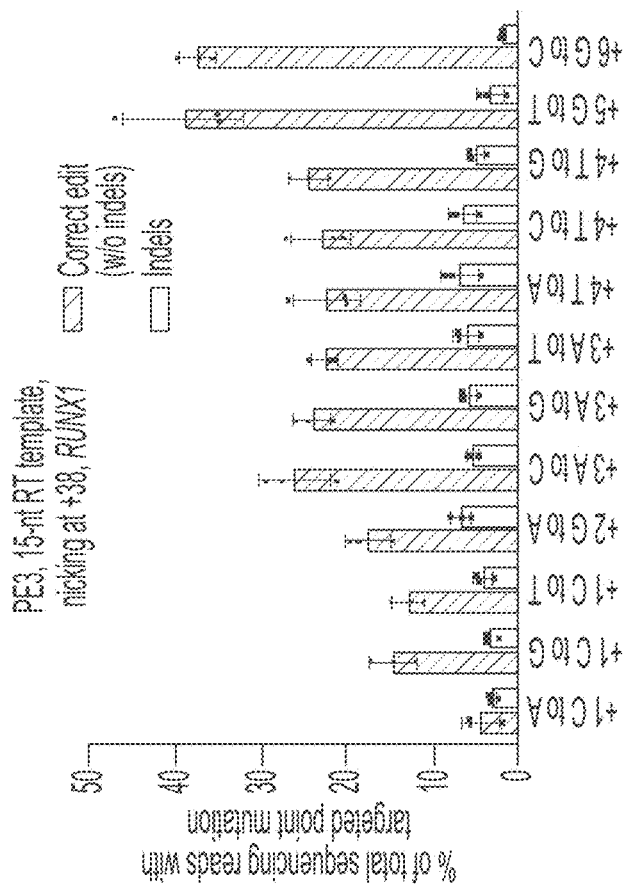
Figure 41H:
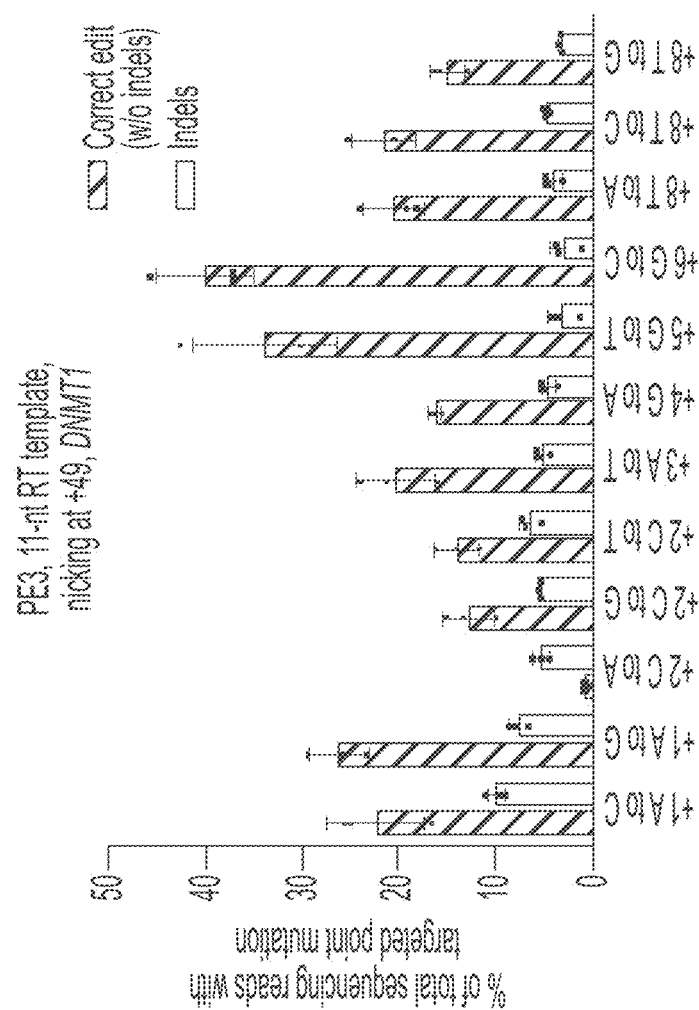
Figure 41I:
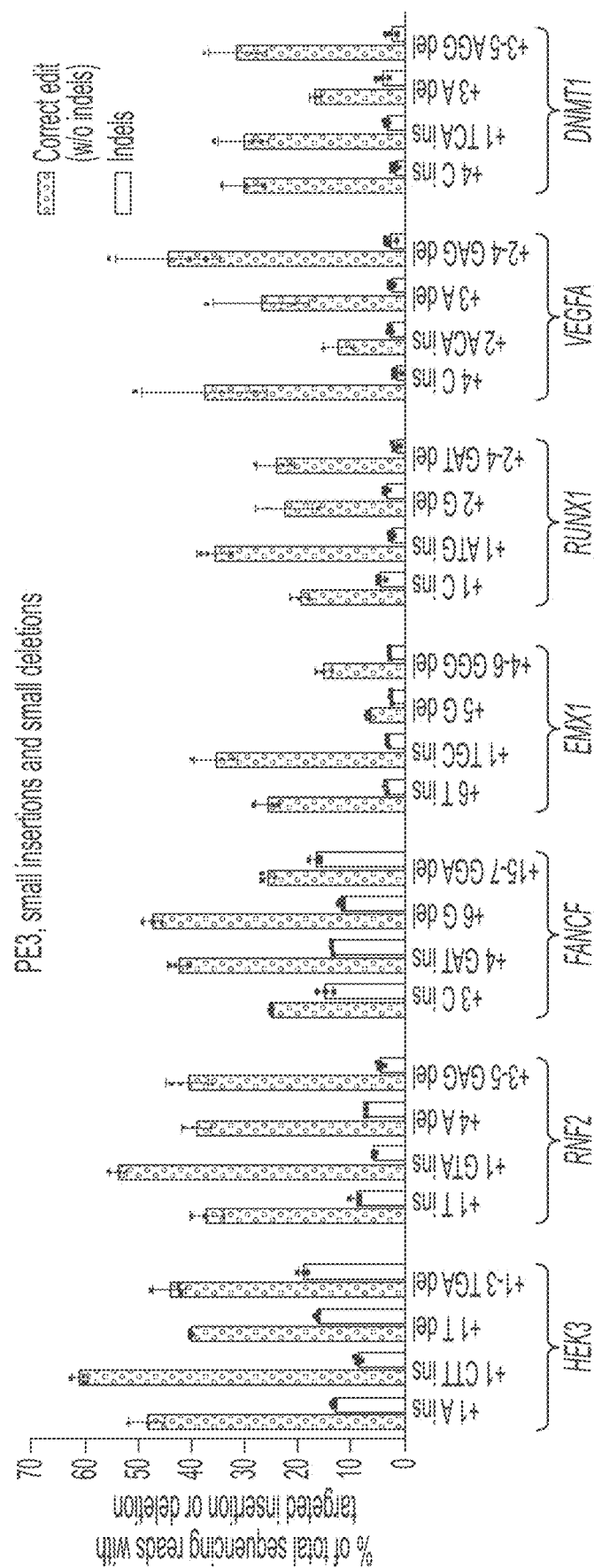
Figure 41K:
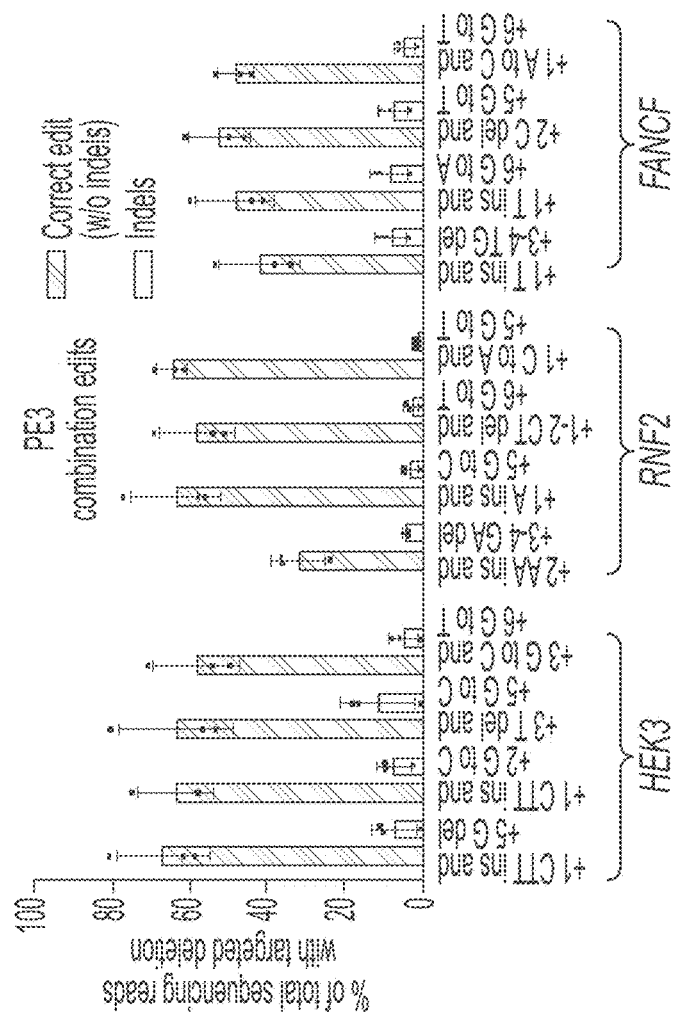
Figure 41J:
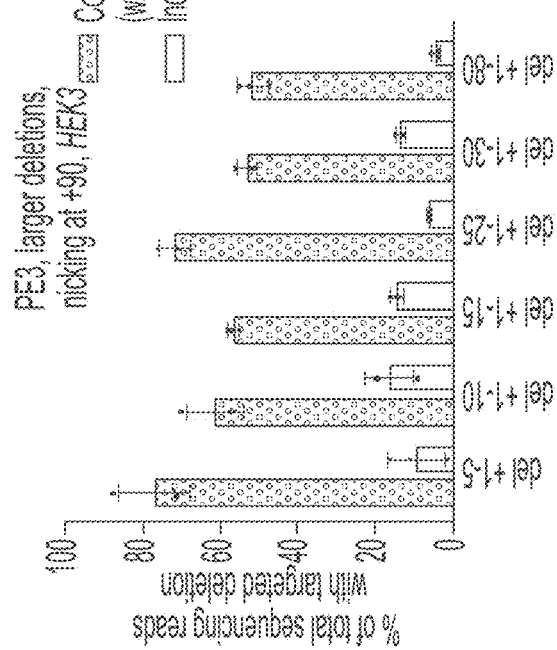

FIGS. 41A-41K show targeted insertions, deletions, and all 12 types of point mutations with PE3 at seven endogenous human genomic loci in HEK293T cells. FIG. 41A is a graph showing all 12 types of single-nucleotide transition and transversion edits from position +1 to +8 (counting the location of the PEgRNA-induced nick as between position +1 and −1) of the HEK3 site using a 10-nt RT template. FIG. 41B is a graph showing long-range PE3 transversion edits at the HEK3 site using a 34-nt RT template. FIGS. 41C-41H are graphs showing all 12 types of transition and transversion edits at various positions in the prime editing window for (FIG. 41C) RNF2, (FIG. 41D) FANCF, (FIG. 41E) EMX1, (FIG. 41F) RUNX1, (FIG. 41G) VEGFA, and (FIG. 41H) DNMT1. FIG. 41I is a graph showing targeted 1- and 3-bp insertions, and 1- and 3-bp deletions with PE3 at seven endogenous genomic loci. FIG. 41J is a graph showing the targeted precise deletions of 5 to 80 bp at the HEK3 target site. FIG. 41K is a graph showing a combination edits of insertions and deletions, insertions and point mutations, deletions and point mutations, and double point mutations at three endogenous genomic loci. All editing yields reflect the percentage of total sequencing reads that contain the intended edit and do not contain indels among all treated cells, with no sorting. Values and error bars reflect the mean and s.d. of three independent biological replicates.

Figure 42C:
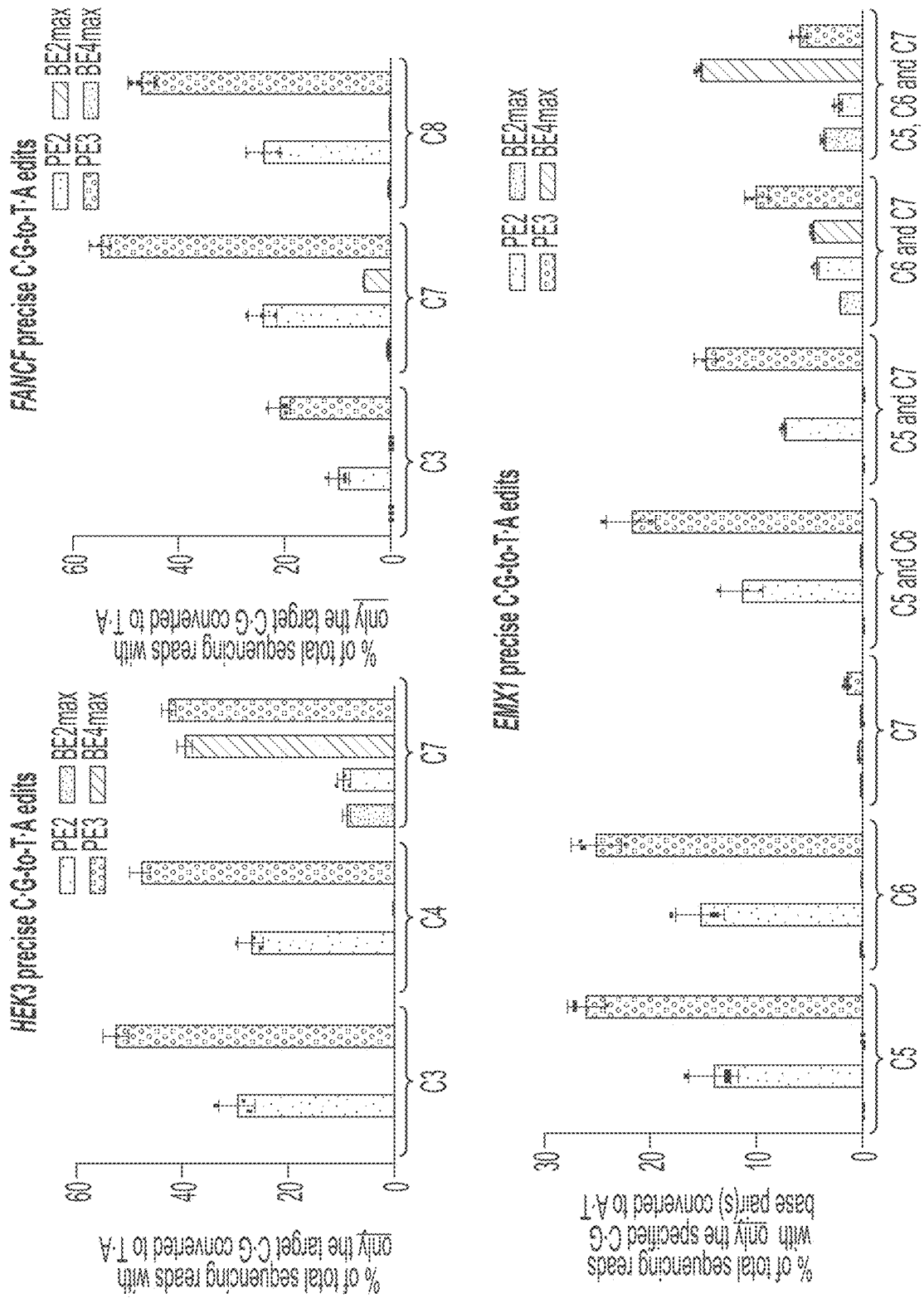
Figure 42D:
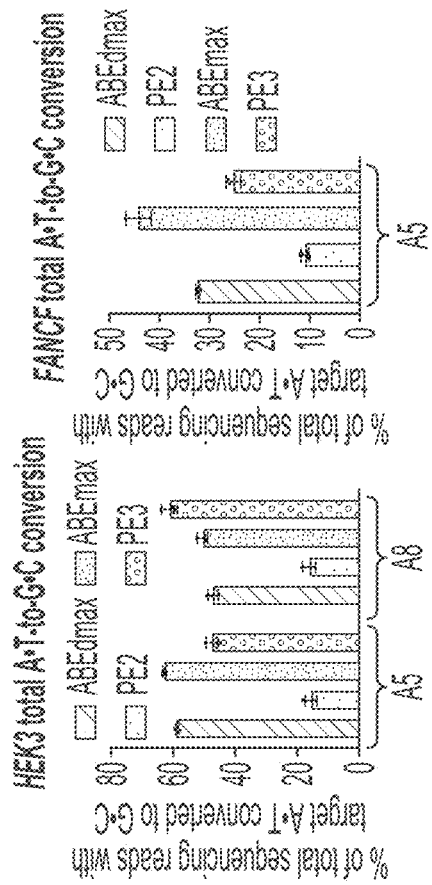
Figure 42F:
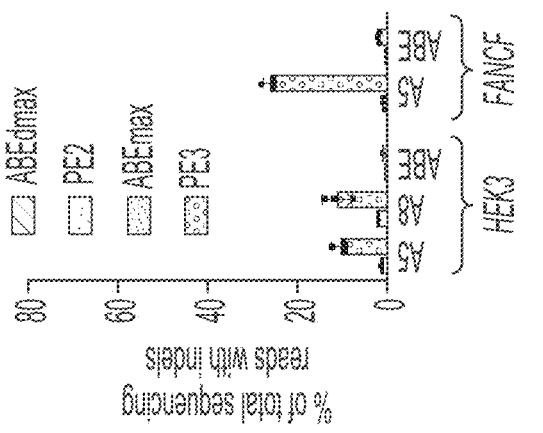
Figure 42E:
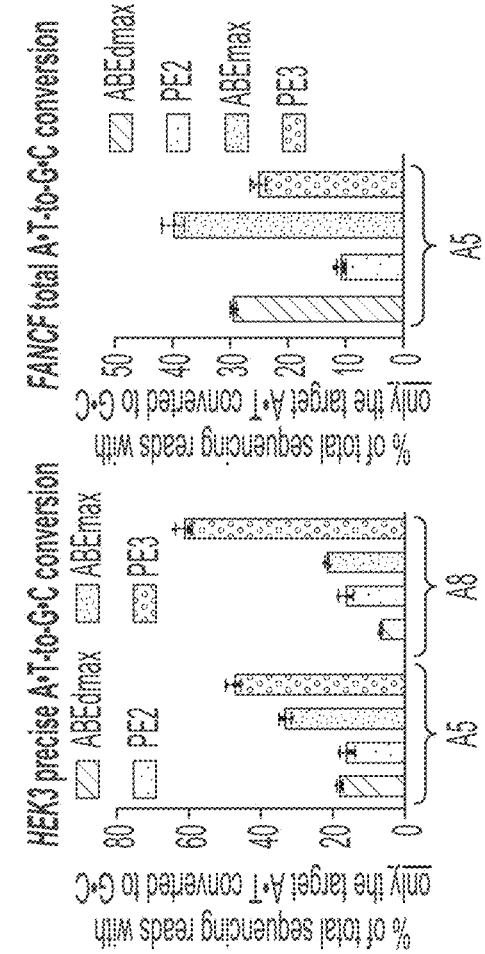
Figure 42G:
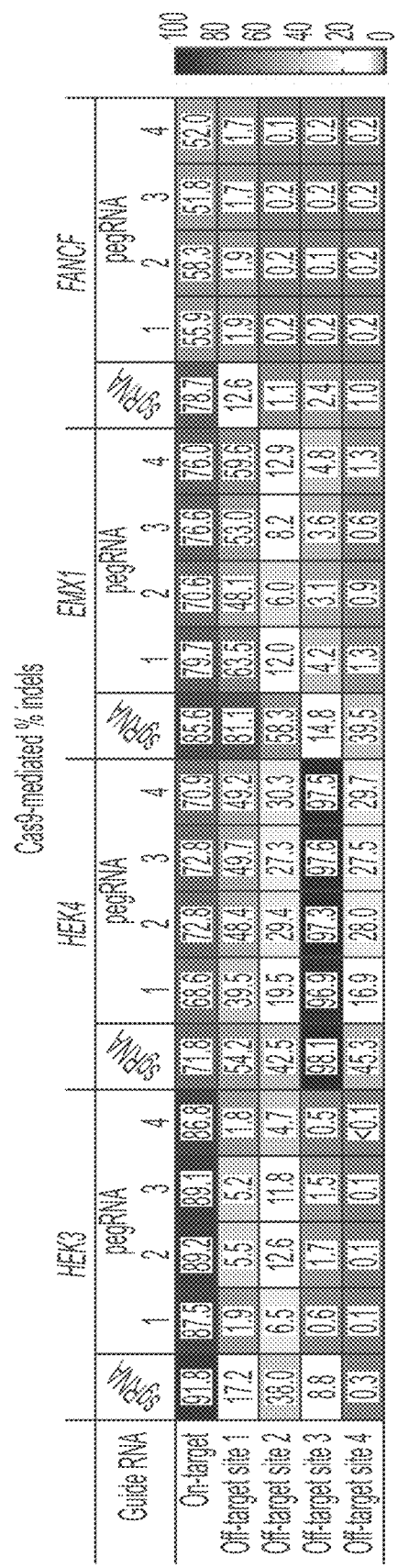
Figure 42H:
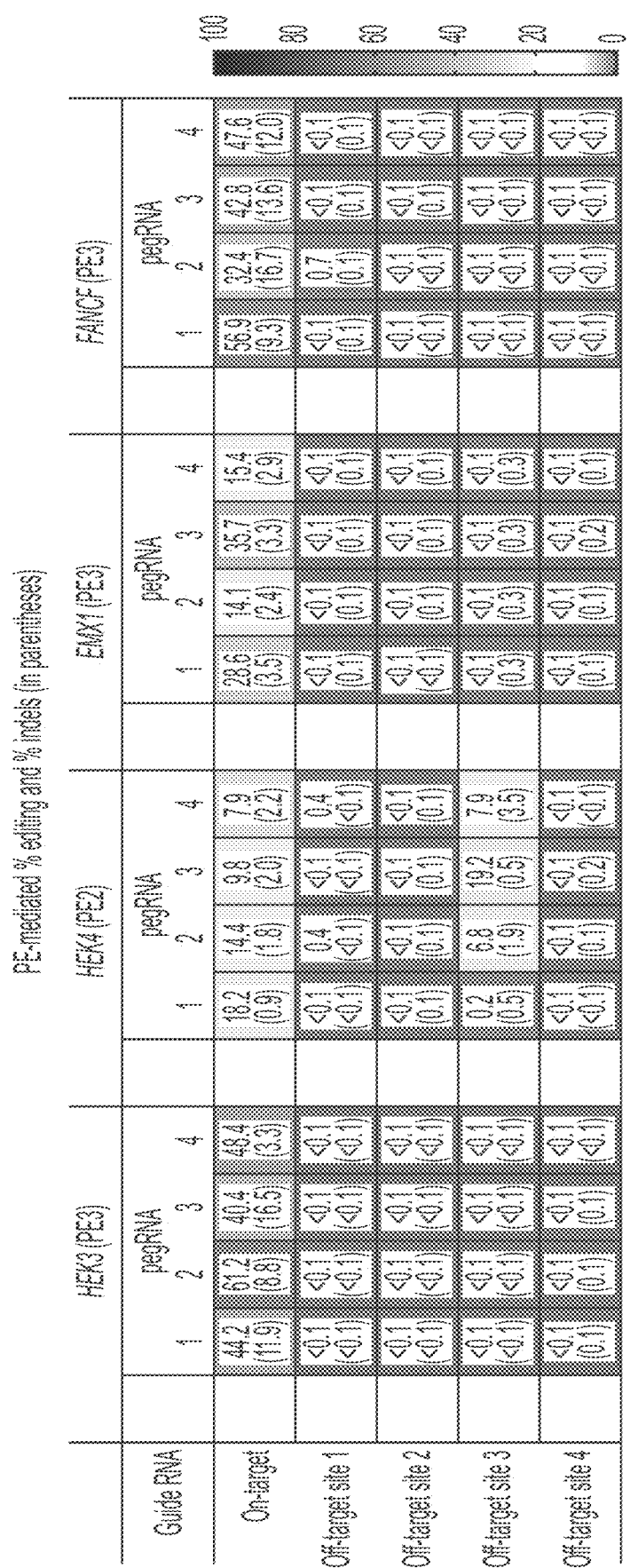

FIGS. 42A-42H show the comparison of prime editing and base editing, and off-target editing by Cas9 and PE3 at known Cas9 off-target sites. FIG. 42A shows total C.G-to-T.A editing efficiency at the same target nucleotides for PE2, PE3, BE2max, and BE4max at endogenous HEK3, FANCF, and EMX1 sites in HEK293T cells. FIG. 42B shows indel frequency from treatments in FIG. 42A. FIG. 42C shows the editing efficiency of precise C.G-to-T.A edits (without bystander edits or indels) for PE2, PE3, BE2max, and BE4max at HEK3, FANCF, and EMX1. For EMX1, precise PE combination edits of all possible combinations of C.G-to-T.A conversion at the three targeted nucleotides are also shown. FIG. 42D shows the total A.T-to-G.C editing efficiency for PE2, PE3, ABEdmax, and ABEmax at HEK3 and FANCF. FIG. 42E shows the precise A.T-to-G.C editing efficiency without bystander edits or indels for at HEK3 and FANCF. FIG. 42F shows indel frequency from treatments in FIG. 42D. FIG. 42G shows the average triplicate editing efficiencies (percentage sequencing reads with indels) in HEK293T cells for Cas9 nuclease at four on-target and 16 known off-target sites. The 16 off-target sites examined were the top four previously reported off-target sites[118,159] for each of the four on-target sites. For each on-target site, Cas9 was paired with a sgRNA or with each of four PEgRNAs that recognize the same protospacer. FIG. 42H shows the average triplicate on-target and off-target editing efficiencies and indel efficiencies (below in parentheses) in HEK293T cells for PE2 or PE3 paired with each PEgRNA in (FIG. 42G). On-target editing yields reflect the percentage of total sequencing reads that contain the intended edit and do not contain indels among all treated cells, with no sorting. Off-target editing yields reflect off-target locus modification consistent with prime editing. Values and error bars reflect the mean and s.d. of three independent biological replicates.

Figure 43A:
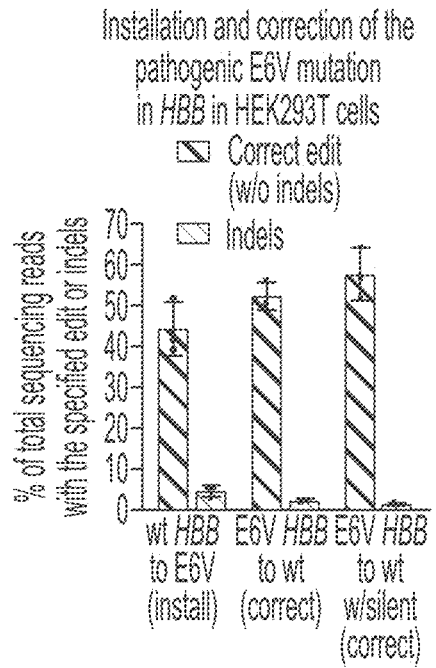
Figure 43B:
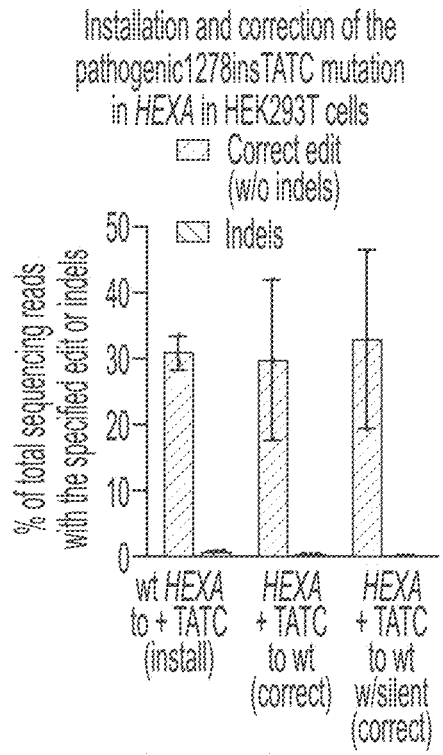
Figure 43C:
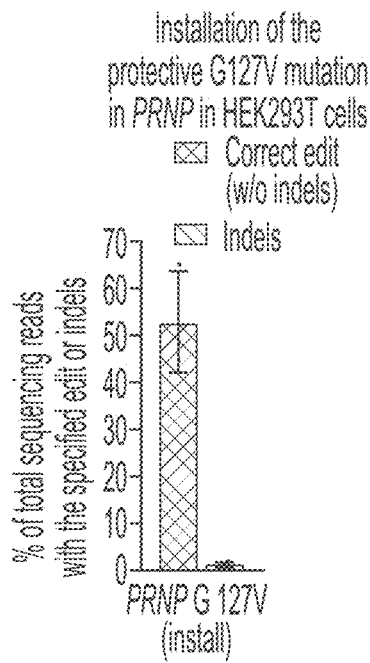
Figure 43D:
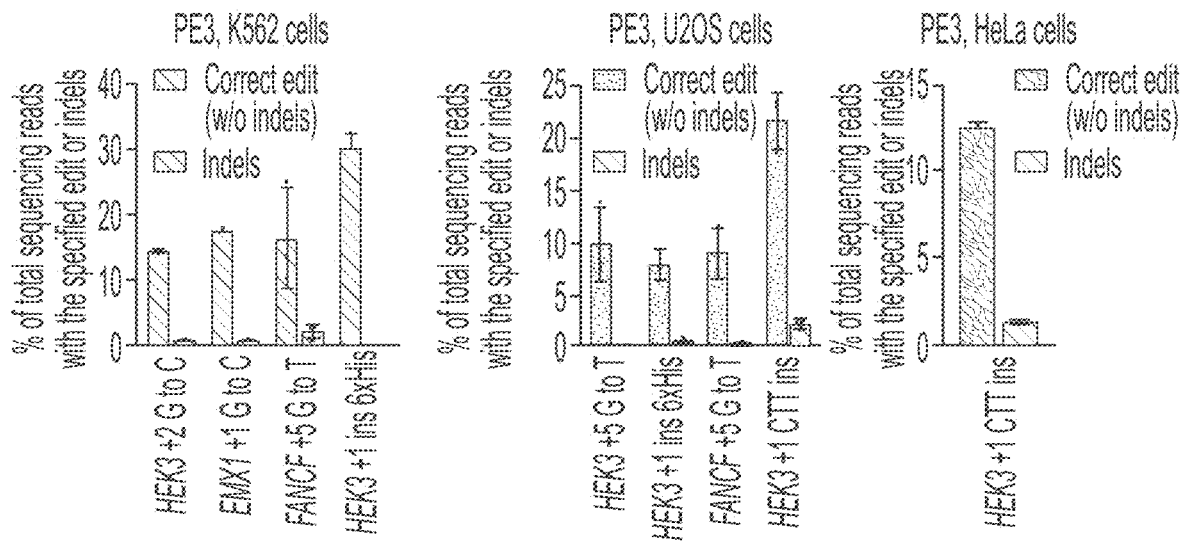
Figure 43E:
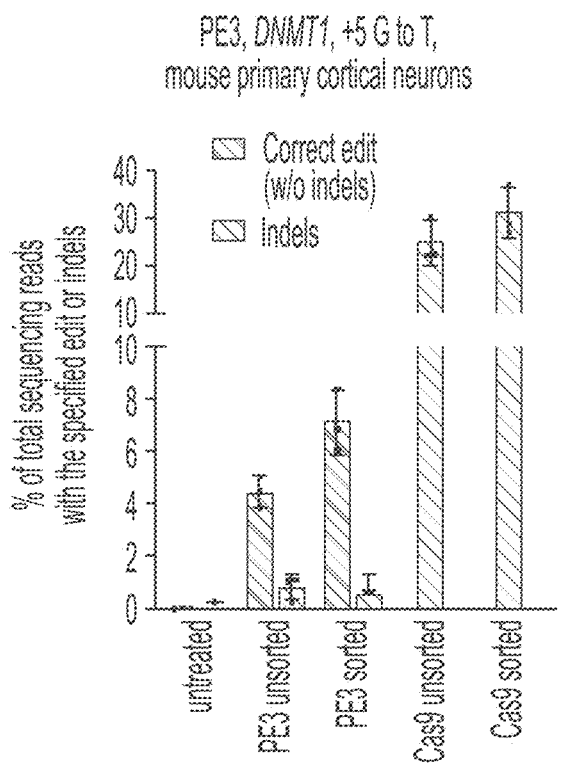
Figure 43F:
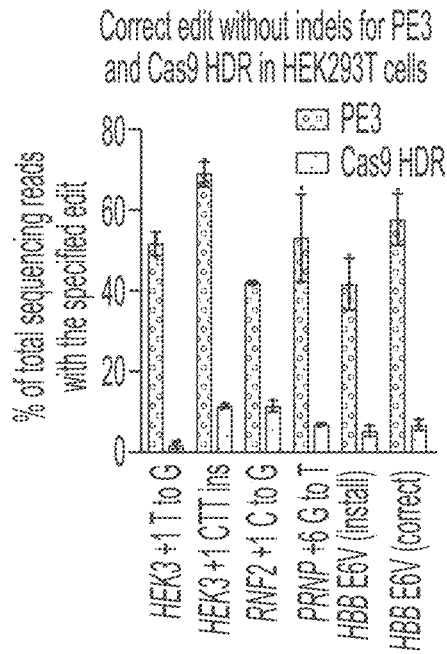
Figure 43G:
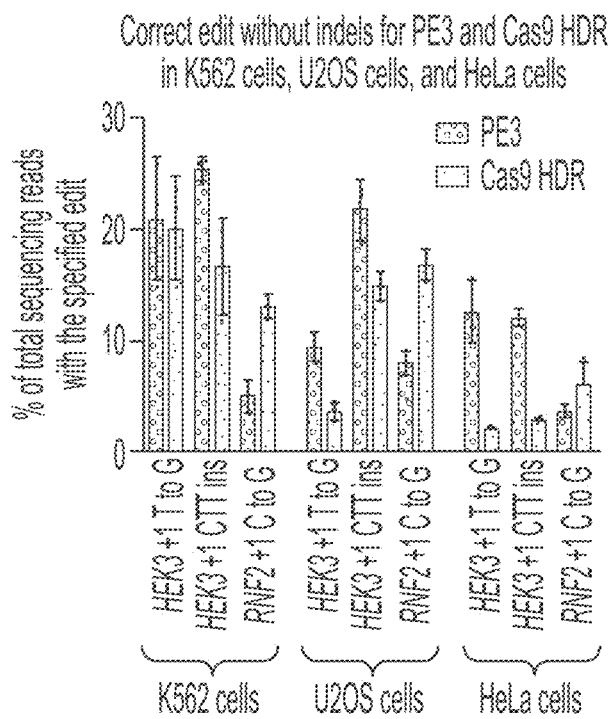
Figure 43H:
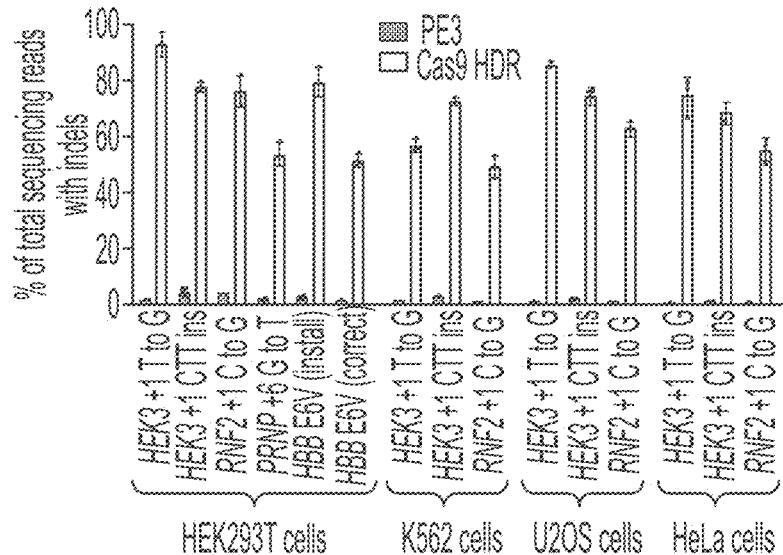
Figure 43I:
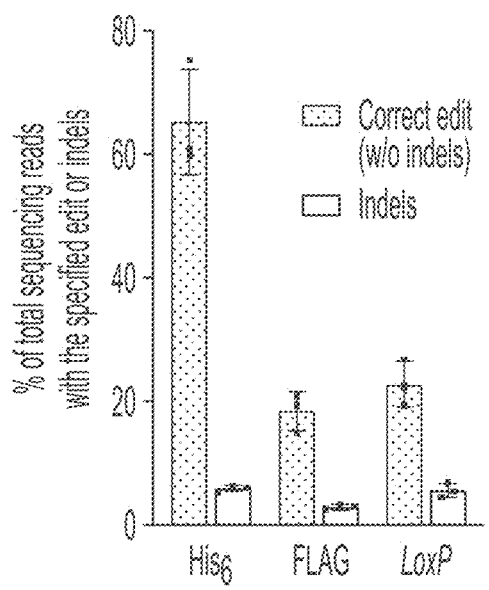

FIGS. 43A-43I show prime editing in various human cell lines and primary mouse cortical neurons, installation and correction of pathogenic transversion, insertion, or deletion mutations, and comparison of prime editing and HDR. FIG. 43A is a graph showing the installation (via T.A-to-A.T transversion) and correction (via A.T-to-T.A transversion) of the pathogenic E6V mutation in HBB in HEK293T cells. Correction either to wild-type HBB, or to HBB containing a silent mutation that disrupts the PEgRNA PAM, is shown. FIG. 43B is a graph showing the installation (via 4-bp insertion) and correction (via 4-bp deletion) of the pathogenic HEXA 1278+TATC allele in HEK293T cells. Correction either to wild-type HEXA, or to HEXA containing a silent mutation that disrupts the PEgRNA PAM, is shown. FIG. 43C is a graph showing the installation of the protective G127V variant in PRNP in HEK293T cells via G.C-to-T.A transversion. FIG. 43D is a graph showing prime editing in other human cell lines including K562 (leukemic bone marrow cells), U2OS (osteosarcoma cells), and HeLa (cervical cancer cells). FIG. 43E is a graph showing the installation of a G.C-to-T.A transversion mutation in DNMT1 of mouse primary cortical neurons using a dual split-intein PE3 lentivirus system, in which the N-terminal half is Cas9 (1-573) fused to N-intein and through a P2A self-cleaving peptide to GFP-KASH, and the C-terminal half is the C-intein fused to the remainder of PE2. PE2 halves are expressed from a human synapsin promoter that is highly specific for mature neurons. Sorted values reflect editing or indels from GFP-positive nuclei, while unsorted values are from all nuclei. FIG. 43F is a comparison of PE3 and Cas9-mediated HDR editing efficiencies at endogenous genomic loci in HEK293T cells. FIG. 43G is a comparison of PE3 and Cas9-mediated HDR editing efficiencies at endogenous genomic loci in K562, U2OS, and HeLa cells. FIG. 43H is a comparison of PE3 and Cas9-mediated HDR indel byproduct generation in HEK293T, K562, U2OS, and HeLa cells. FIG. 43I shows targeted insertion of a His6 tag (18 bp), FLAG epitope tag (24 bp), or extended LoxP site (44 bp) in HEK293T cells by PE3. All editing yields reflect the percentage of total sequencing reads that contain the intended edit and do not contain indels among all treated cells. Values and error bars reflect the mean and s.d. of three independent biological replicates.

Figure 44B:
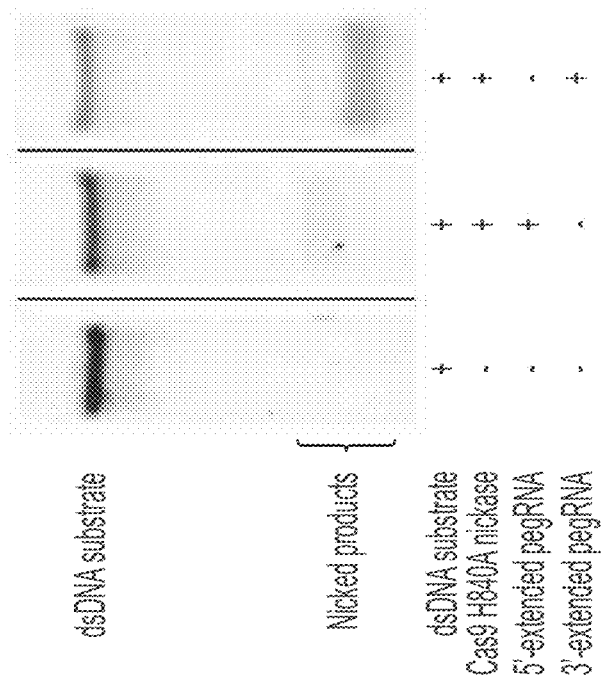
Figure 44A:
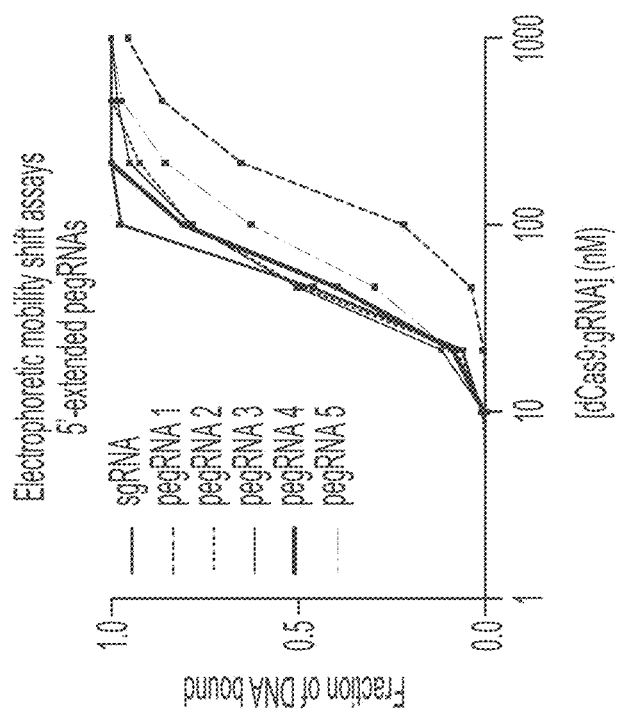
Figure 44C:
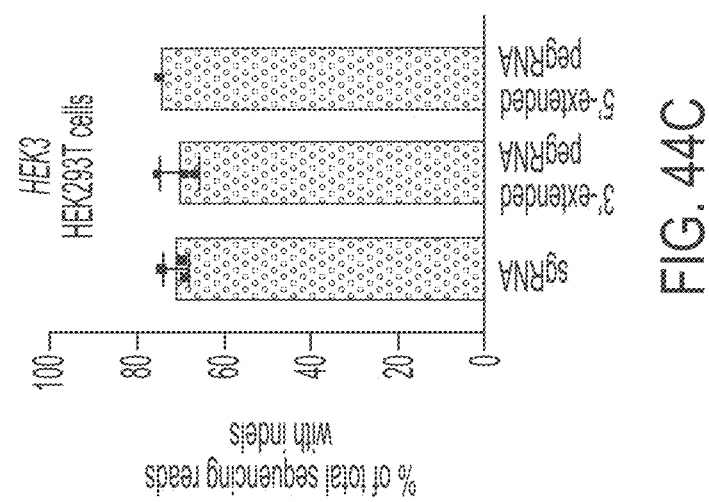
Figure 44D:
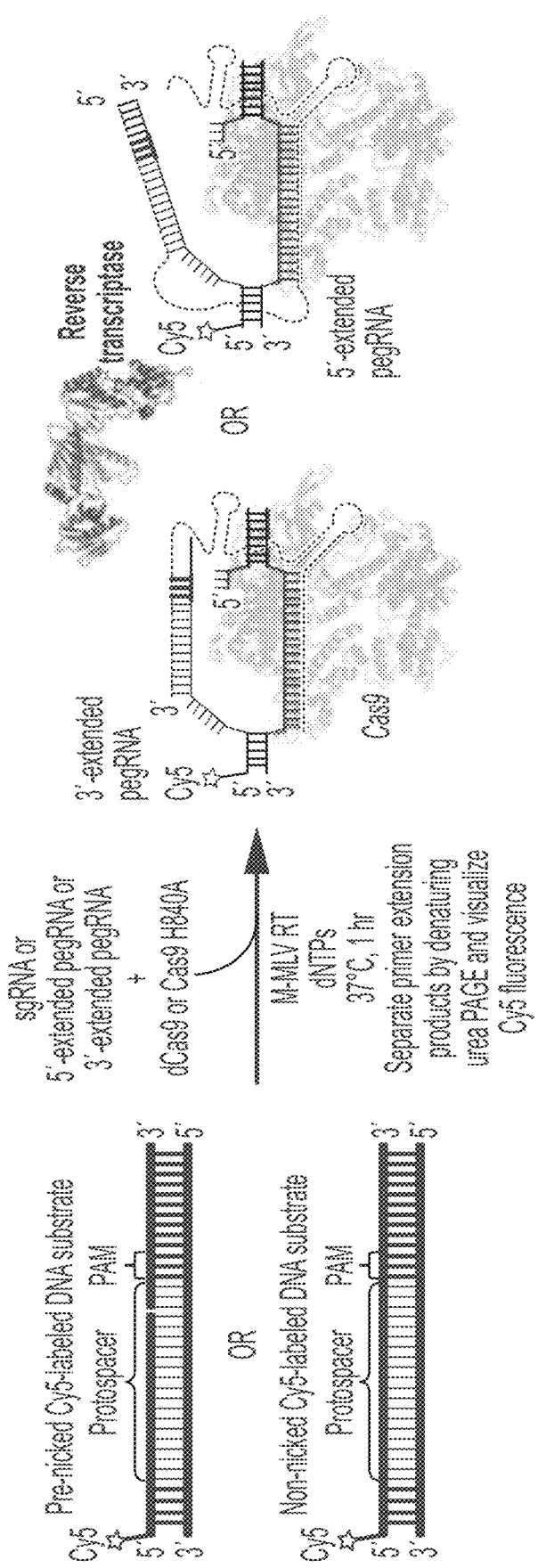
Figures 44E, 44F:
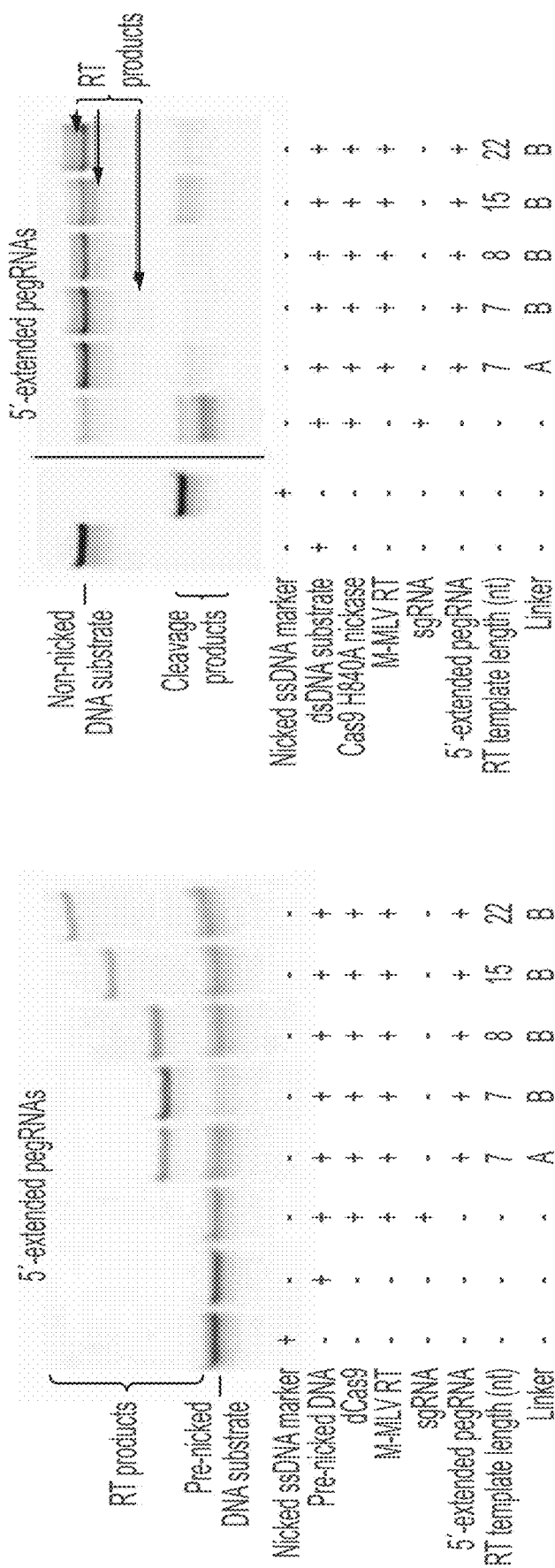
Figure 44G:
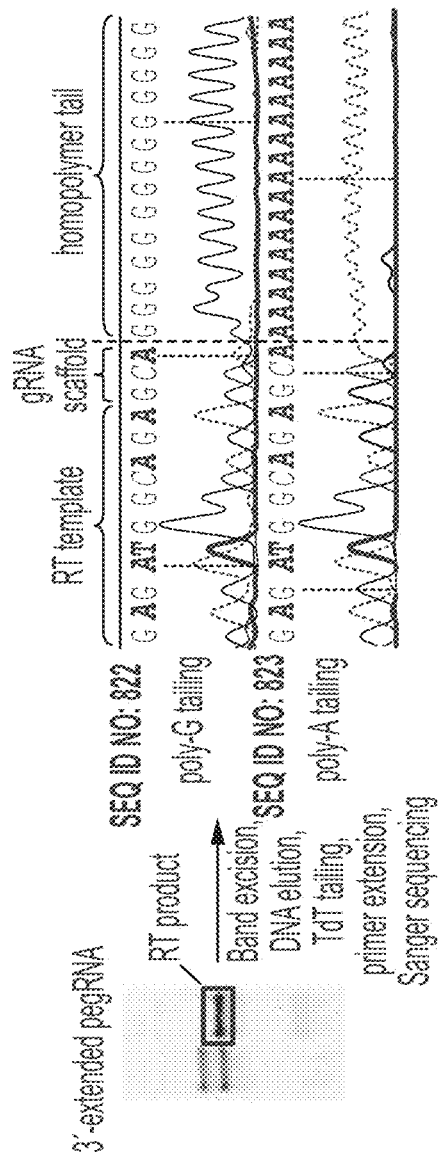

FIGS. 44A-44G show in vitro prime editing validation studies with fluorescently labeled DNA substrates. FIG. 44A shows electrophoretic mobility shift assays with dCas9, 5'-extended PEgRNAs and 5'-Cy5-labeled DNA substrates. PEgRNAs 1 through 5 contain a 15-nt linker sequence (linker A for PEgRNA 1, linker B for PEgRNAs 2 through 5) between the spacer and the PBS, a 5-nt PBS sequence, and RT templates of 7 nt (PEgRNAs 1 and 2), 8 nt (PEgRNA 3), 15 nt (PEgRNA 4), and 22 nt (PEgRNA 5). PEgRNAs are those used in FIGS. 44E and 44F; full sequences are listed in Tables 2A-2C. FIG. 44B shows in vitro nicking assays of Cas9 H840A using 5'-extended and 3'-extended PEgRNAs. FIG. 44C shows Cas9-mediated indel formation in HEK293T cells at HEK3 using 5'-extended and 3'-extended PEgRNAs. FIG. 44D shows an overview of prime editing in vitro biochemical assays. 5'-Cy5-labeled pre-nicked and non-nicked dsDNA substrates were tested. sgRNAs, 5'-extended PEgRNAs, or 3'-extended PEgRNAs were pre-complexed with dCas9 or Cas9 H840A nickase, then combined with dsDNA substrate, M-MLV RT, and dNTPs. Reactions were allowed to proceed at 37° C. for 1 hour prior to separation by denaturing urea PAGE and visualization by Cy5 fluorescence. FIG. 44E shows primer extension reactions using 5'-extended PEgRNAs, pre-nicked DNA substrates, and dCas9 lead to significant conversion to RT products. FIG. 44F shows primer extension reactions using 5'-extended PEgRNAs as in FIG. 44B, with non-nicked DNA substrate and Cas9 H840A nickase. Product yields are greatly reduced by comparison to pre-nicked substrate. FIG. 44G shows an in vitro primer extension reaction using a 3'-PEgRNA generates a single apparent product by denaturing urea PAGE. The RT product band was excised, eluted from the gel, then subjected to homopolymer tailing with terminal transferase (TdT) using either dGTP or dATP. Tailed products were extended by poly-T or poly-C primers, and the resulting DNA was sequenced. Sanger traces indicate that three nucleotides derived from the gRNA scaffold were reverse transcribed (added as the final 3' nucleotides to the DNA product). Note that in mammalian cell prime editing experiments, PEgRNA scaffold insertion is much rarer than in vitro (FIGS. 56A-56D), potentially due to the inability of the tethered reverse transcriptase to access the Cas9-bound guide RNA scaffold, and/or cellular excision of mismatched 3' ends of 3' flaps containing PEgRNA scaffold sequences.

Figure 45A:
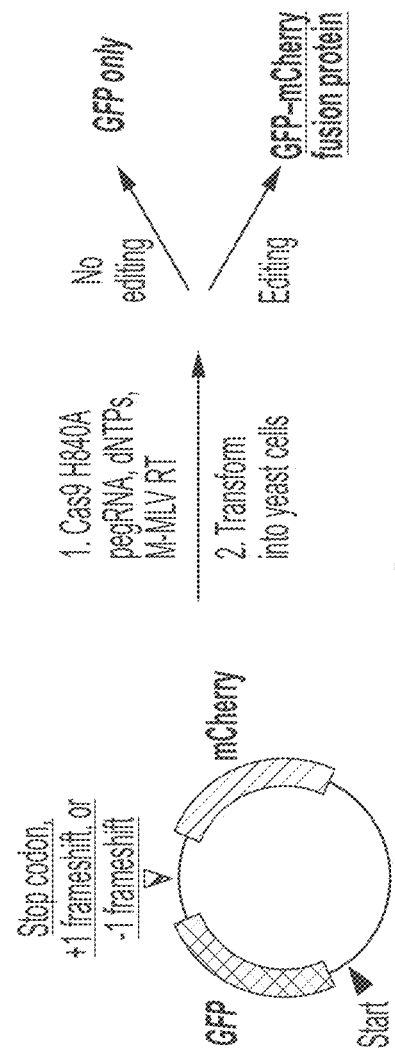
Figure 45B:
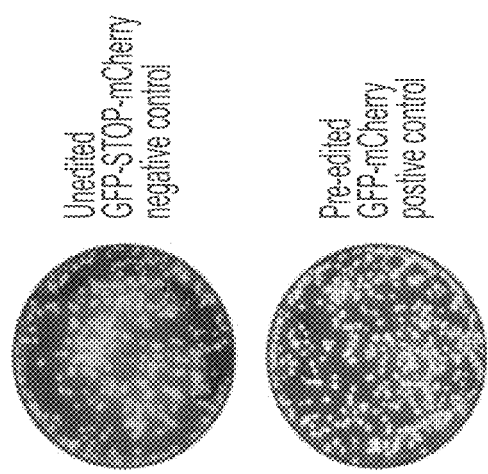
Figure 45C:
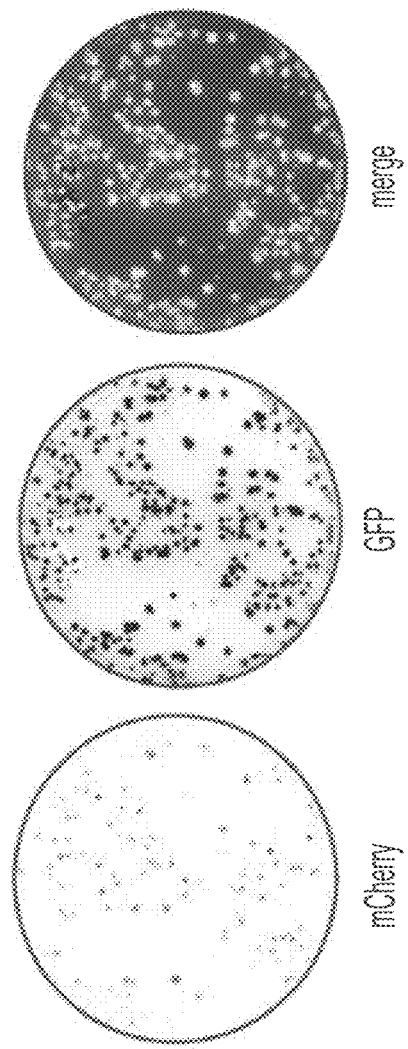
Figure 45D:
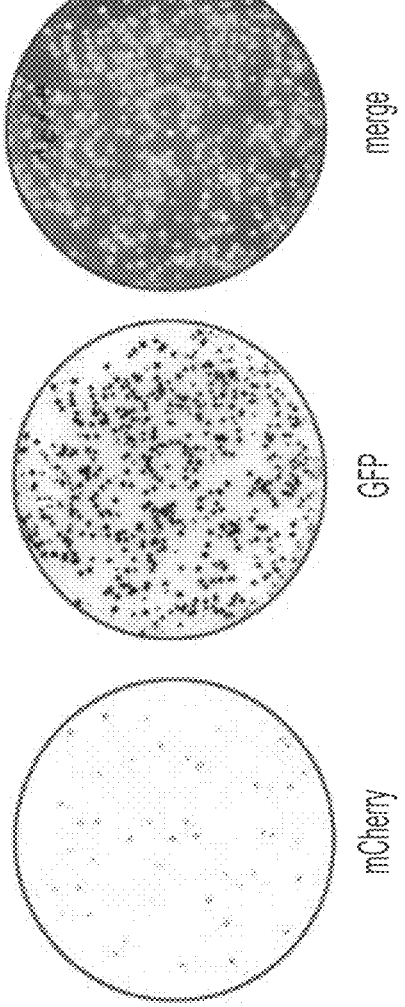
Figure 45E:
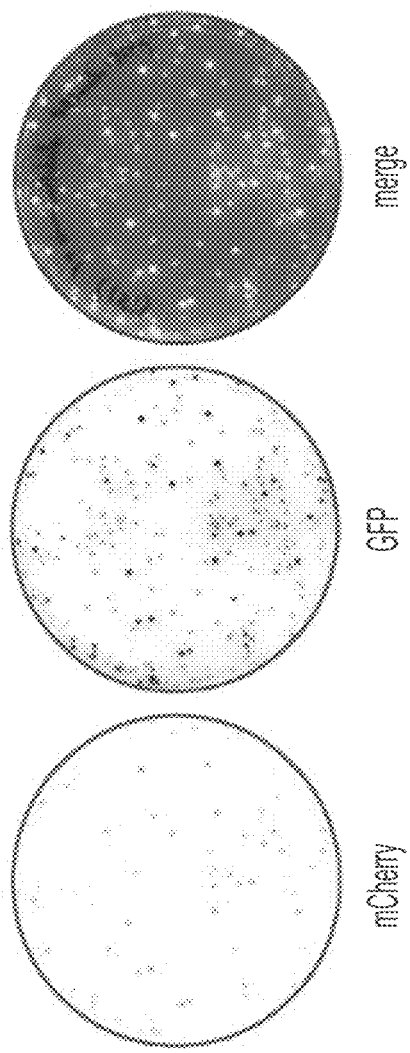
Figure 45F:
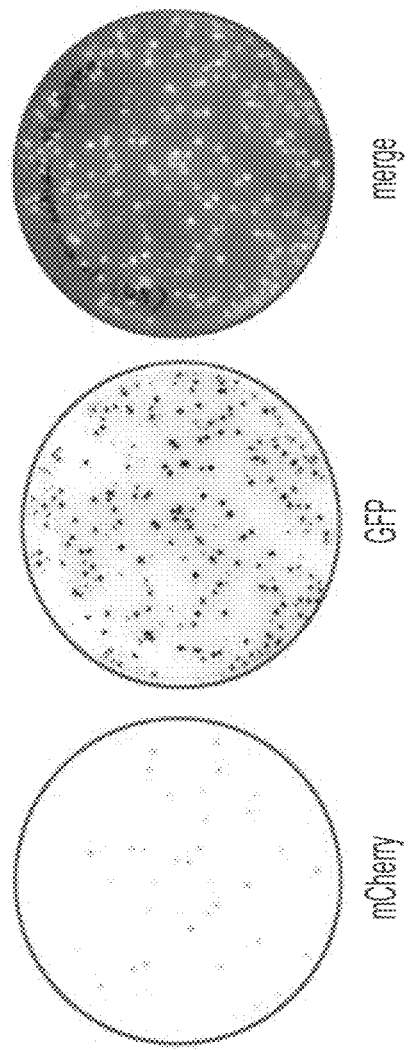
Figure 45G:
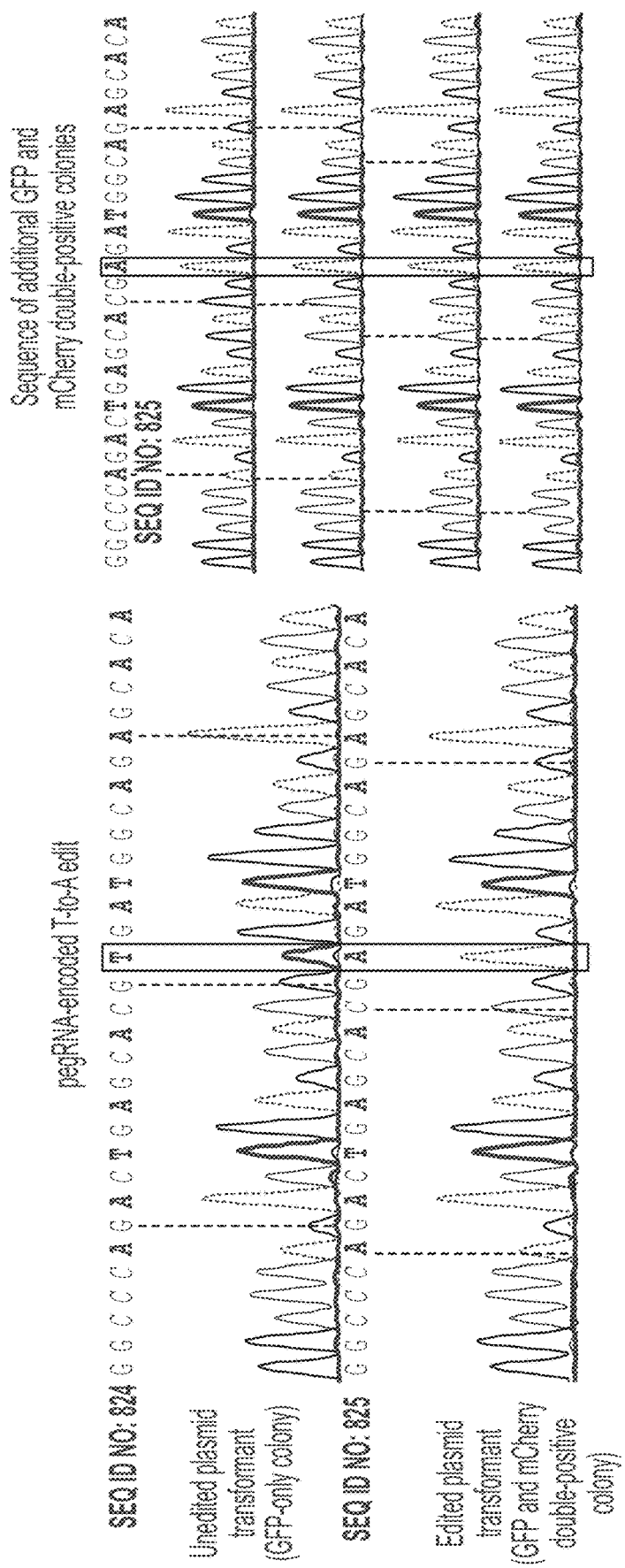

FIGS. 45A-45G show cellular repair in yeast of 3' DNA flaps from in vitro prime editing reactions. FIG. 45A shows that dual fluorescent protein reporter plasmids contain GFP and mCherry open reading frames separated by a target site encoding an in-frame stop codon, a +1 frameshift, or a −1 frameshift. Prime editing reactions were carried out in vitro with Cas9 H840A nickase, PEgRNA, dNTPs, and M-MLV reverse transcriptase, and then transformed into yeast. Colonies that contain unedited plasmids produce GFP but not mCherry. Yeast colonies containing edited plasmids produce both GFP and mCherry as a fusion protein. FIG. 45B shows an overlay of GFP and mCherry fluorescence for yeast colonies transformed with reporter plasmids containing a stop codon between GFP and mCherry (unedited negative control, top), or containing no stop codon or frameshift between GFP and mCherry (pre-edited positive control, bottom). FIGS. 45C-45F show a visualization of mCherry and GFP fluorescence from yeast colonies transformed with in vitro prime editing reaction products. FIG. 45C shows a stop codon correction via T.A-to-A.T transversion using a 3'-extended PEgRNA, or a 5'-extended PEgRNA, as shown in FIG. 45D. FIG. 45E shows a +1 frameshift correction via a 1-bp deletion using a 3'-extended PEgRNA. FIG. 45F shows a −1 frameshift correction via a 1-bp insertion using a 3'-extended PEgRNA. FIG. 45G shows Sanger DNA sequencing traces from plasmids isolated from GFP-only colonies in FIG. 45B and GFP and mCherry double-positive colonies in FIG. 45C.

Figure 46A:
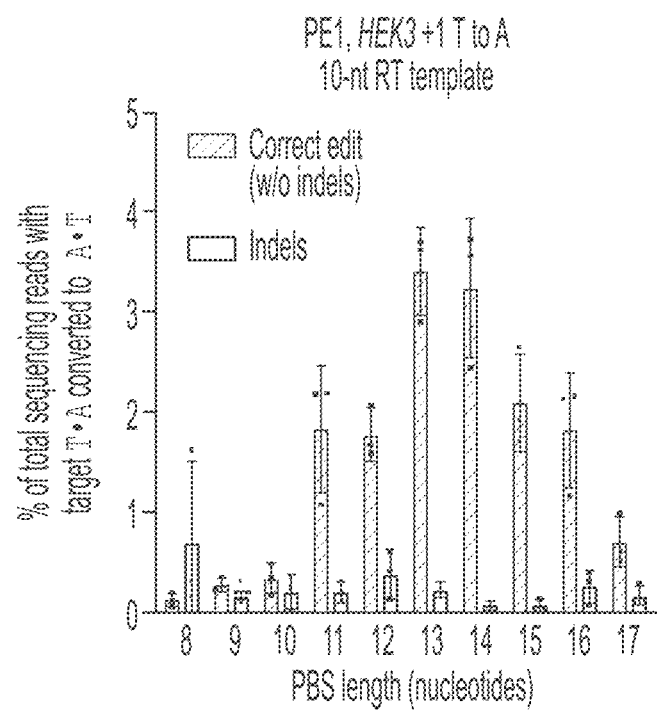
Figure 46B:
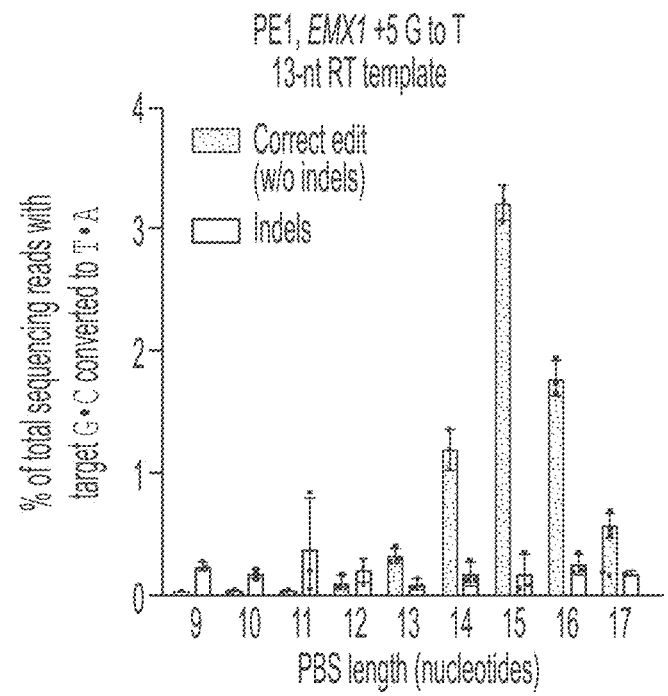
Figure 46C:
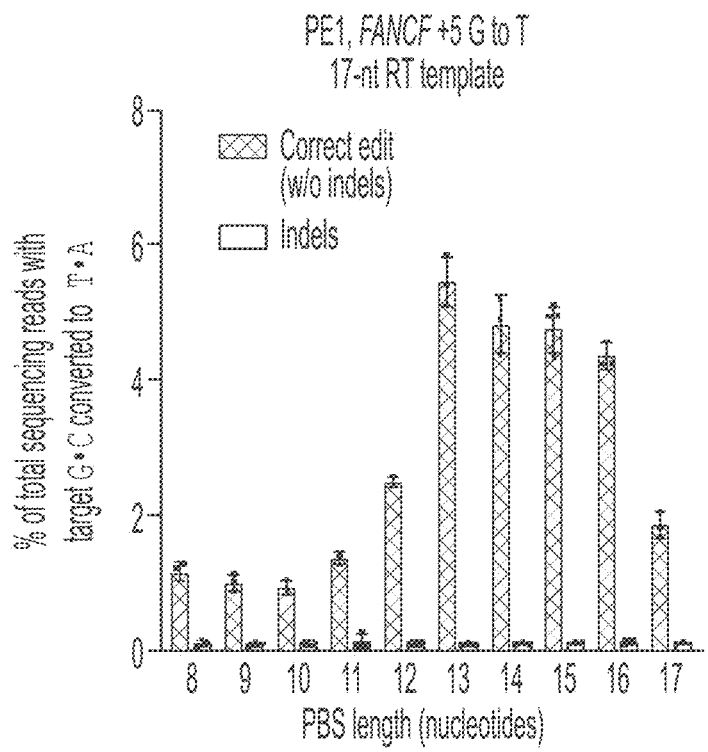
Figure 46D:
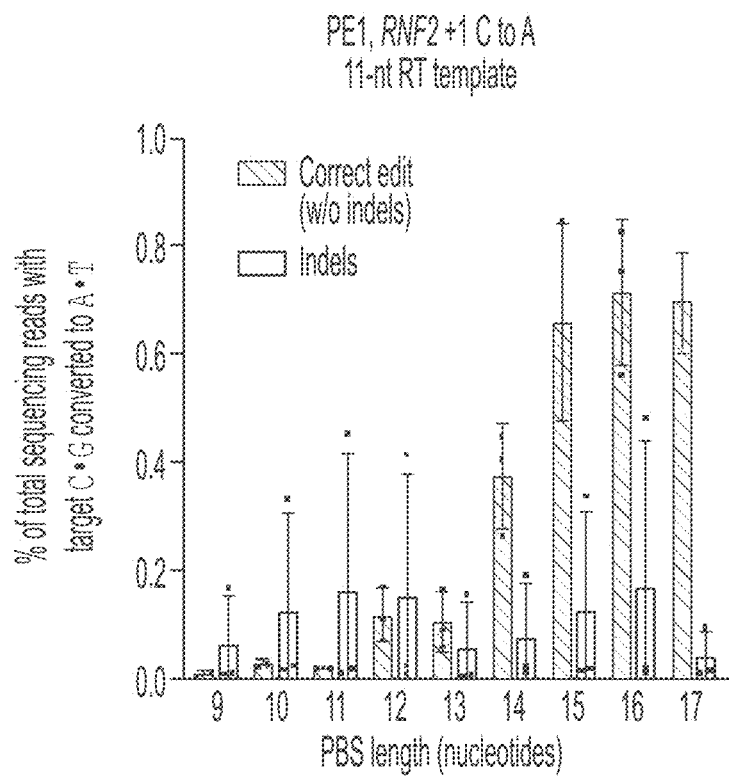
Figure 46E:
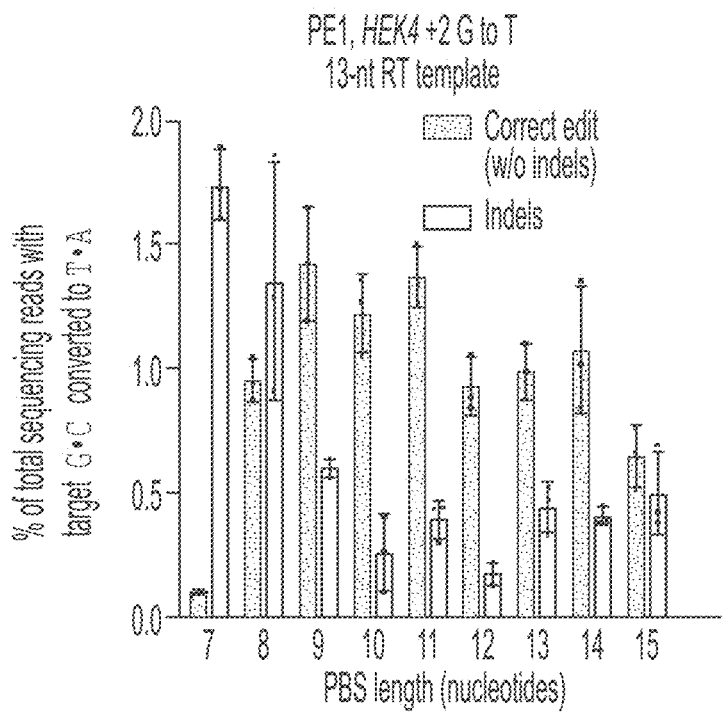
Figures 46F, 47A:
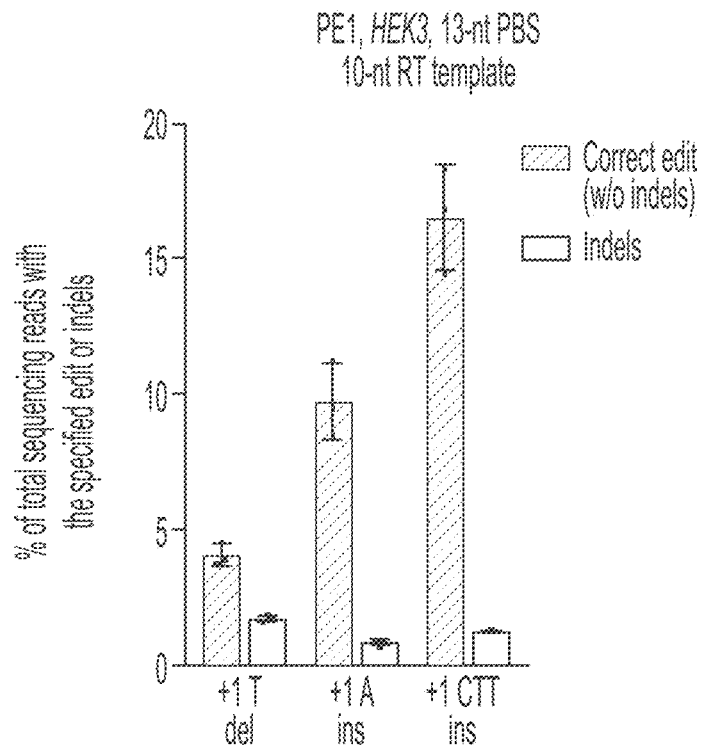

FIGS. 46A-46F show correct editing versus indel generation with PE1. FIG. 46A shows T.A-to-A.T transversion editing efficiency and indel generation by PE1 at the +1 position of HEK3 using PEgRNAs containing 10-nt RT templates and a PBS sequences ranging from 8-17 nt. FIG. 46B shows G.C-to-T.A transversion editing efficiency and indel generation by PE1 at the +5 position of EMX1 using PEgRNAs containing 13-nt RT templates and a PBS sequences ranging from 9-17 nt. FIG. 46C shows G.C-to-T.A transversion editing efficiency and indel generation by PE1 at the +5 position of FANCF using PEgRNAs containing 17-nt RT templates and a PBS sequences ranging from 8-17 nt. FIG. 46D shows C.G-to-A.T transversion editing efficiency and indel generation by PE1 at the +1 position of RNF2 using PEgRNAs containing 11-nt RT templates and a PBS sequences ranging from 9-17 nt. FIG. 46E shows G.C-to-T.A transversion editing efficiency and indel generation by PE1 at the +2 position of HEK4 using PEgRNAs containing 13-nt RT templates and a PBS sequences ranging from 7-15 nt. FIG. 46F shows PE1-mediated +1 T deletion, +1 A insertion, and +1 CTT insertion at the HEK3 site using a 13-nt PBS and 10-nt RT template. Sequences of PEgRNAs are those used in FIG. 39C (see Tables 3A-3R). Values and error bars reflect the mean and s.d. of three independent biological replicates.

Figure 47B:
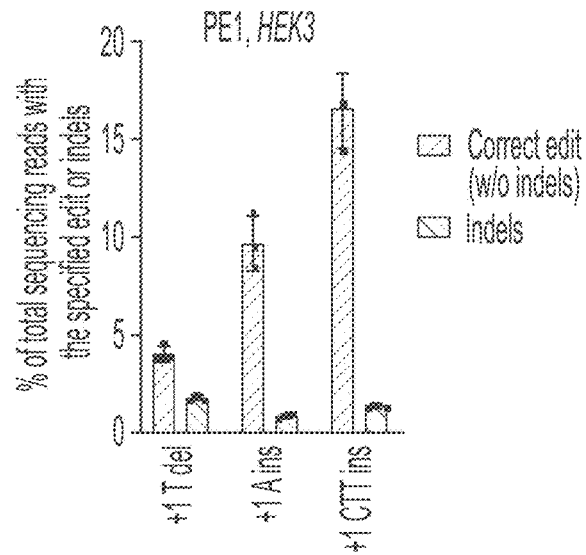
Figure 47C:
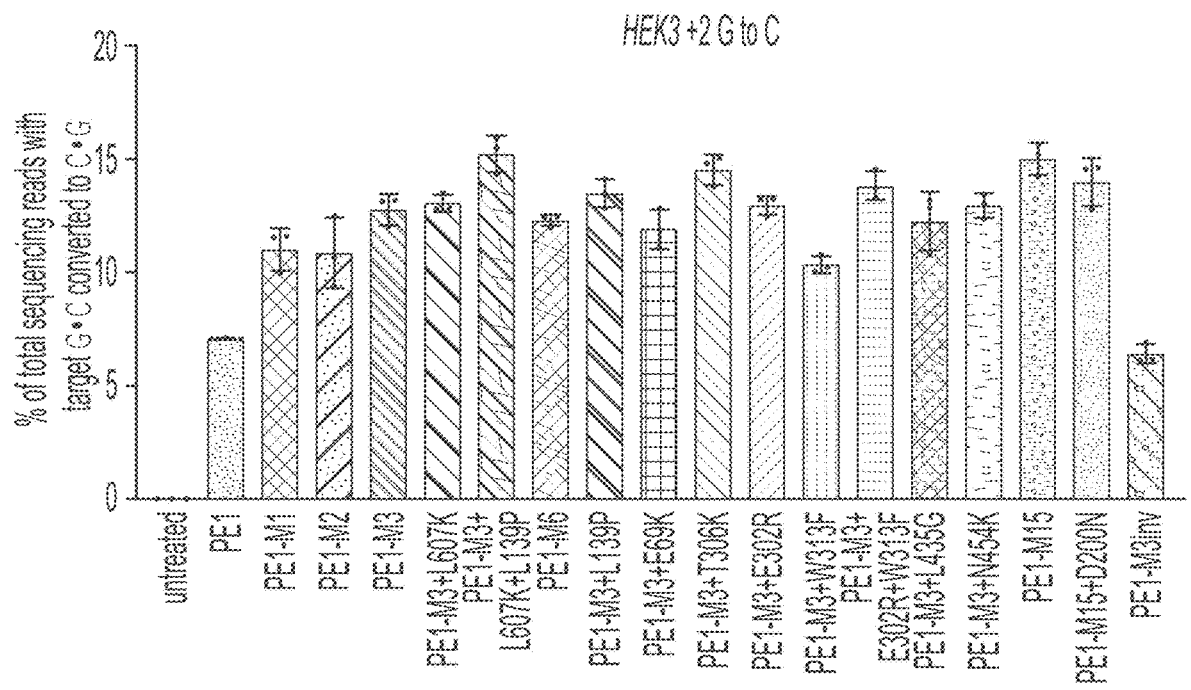
Figure 47D:
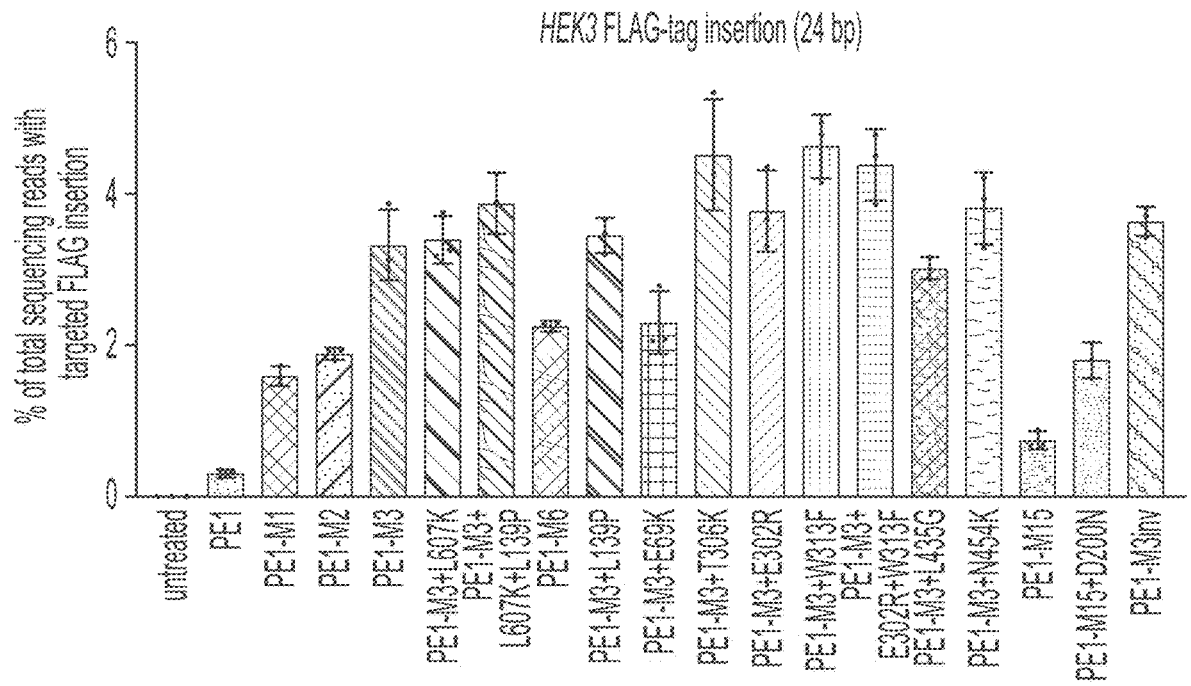
Figure 47E:
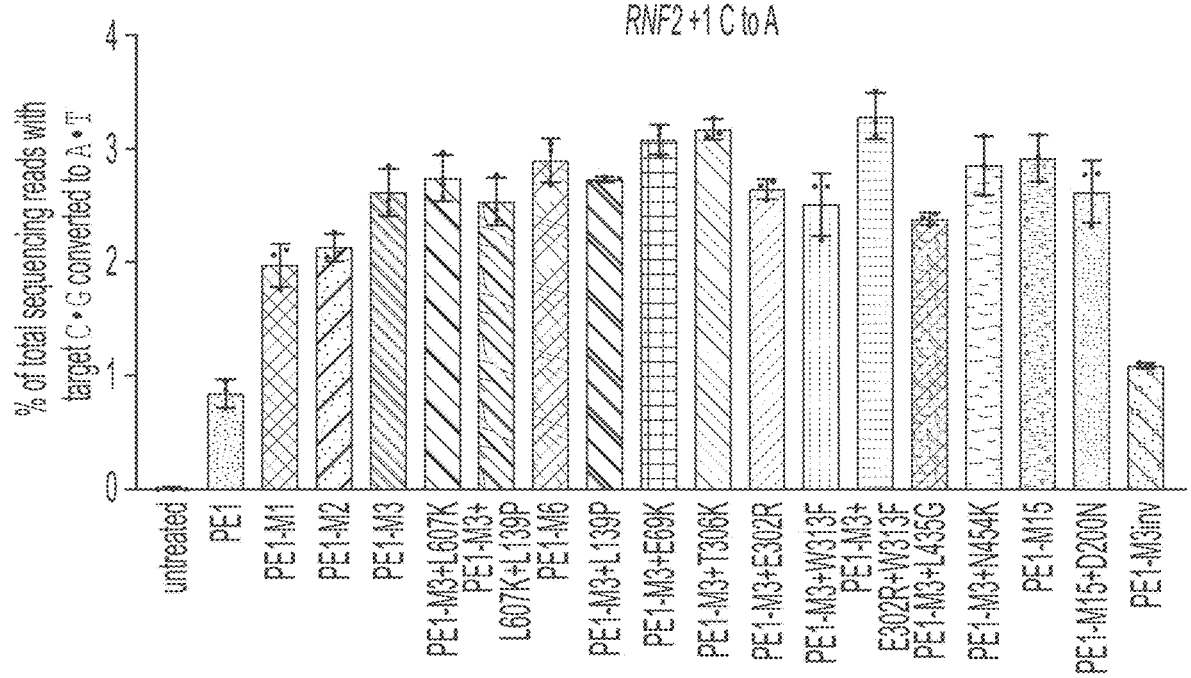
Figure 47F:
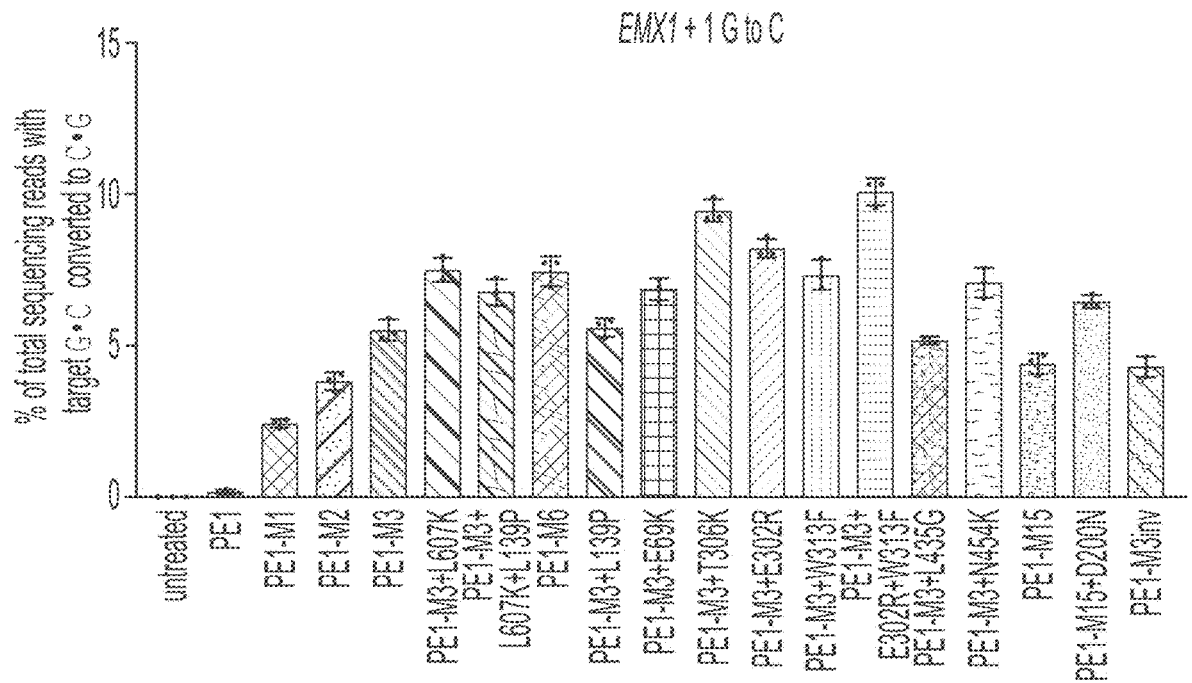
Figure 47G:
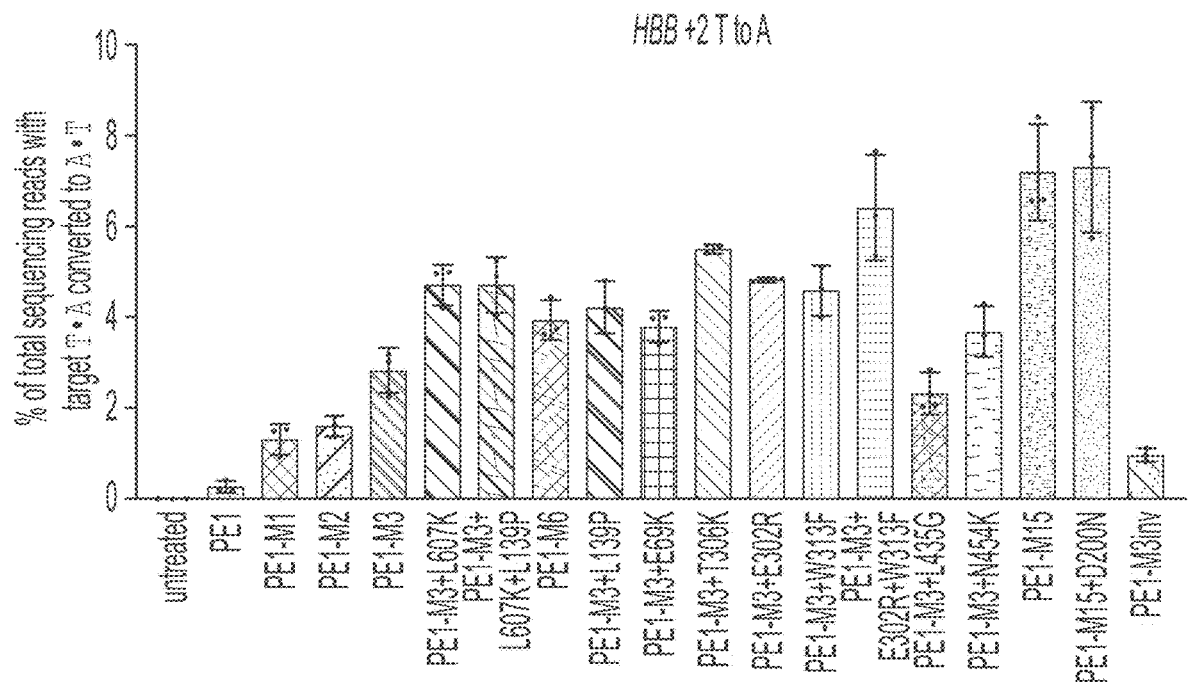
Figure 47H:
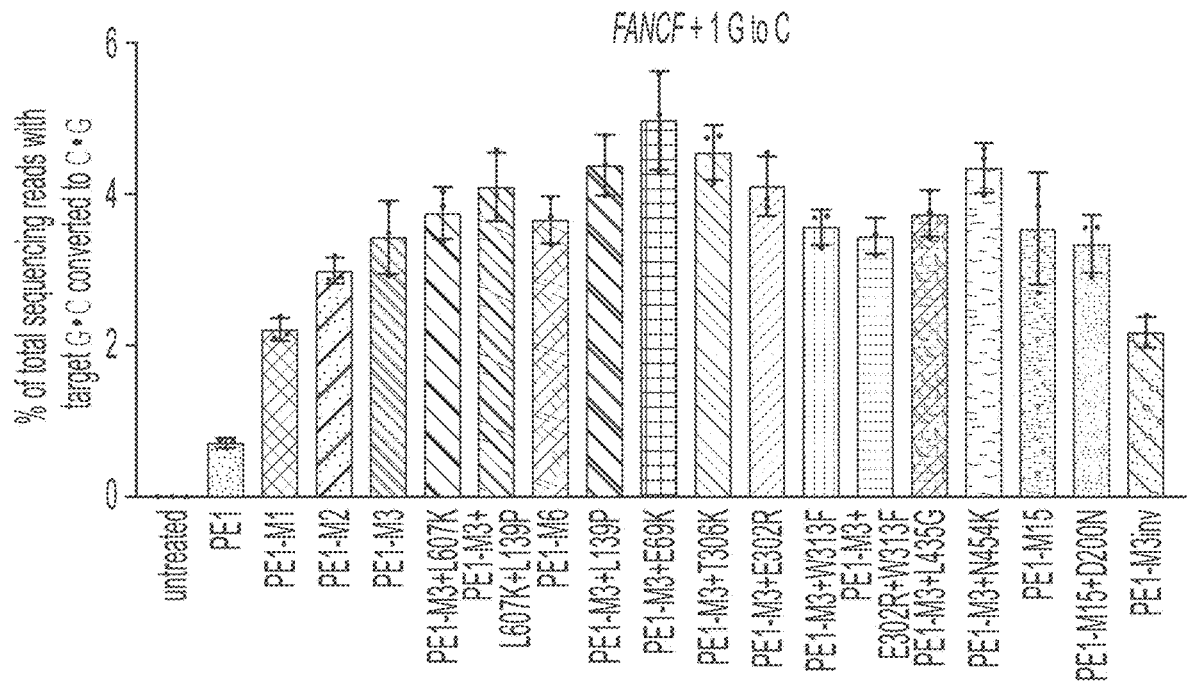
Figure 47I:
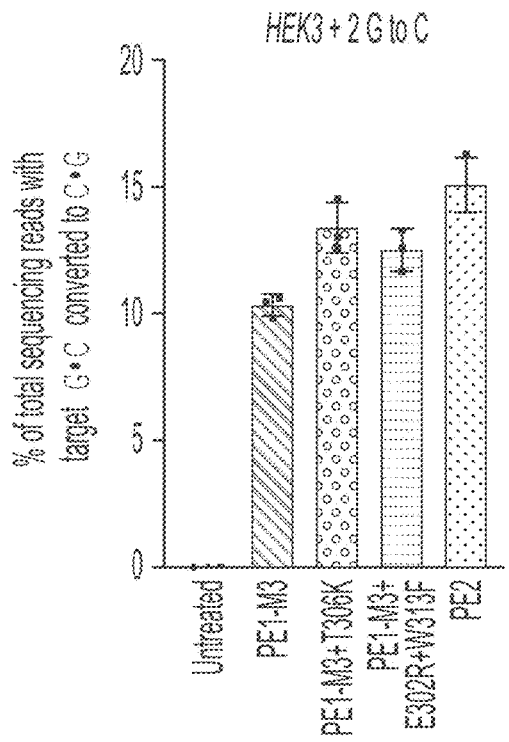
Figure 47J:
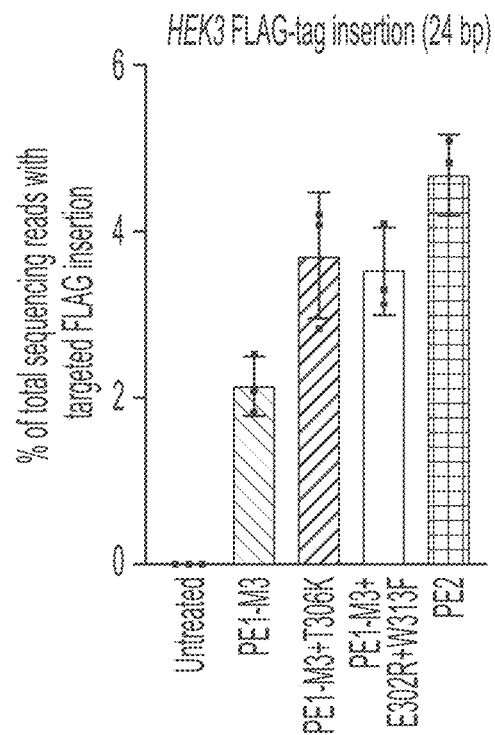
Figure 47K:
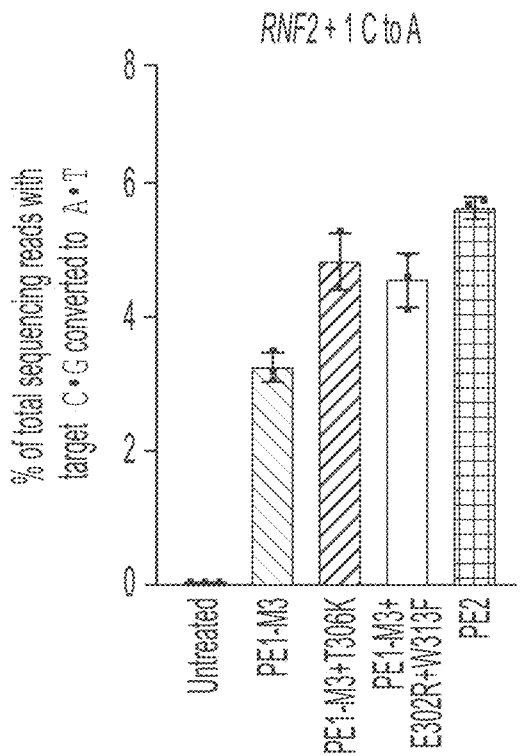
Figure 47L:
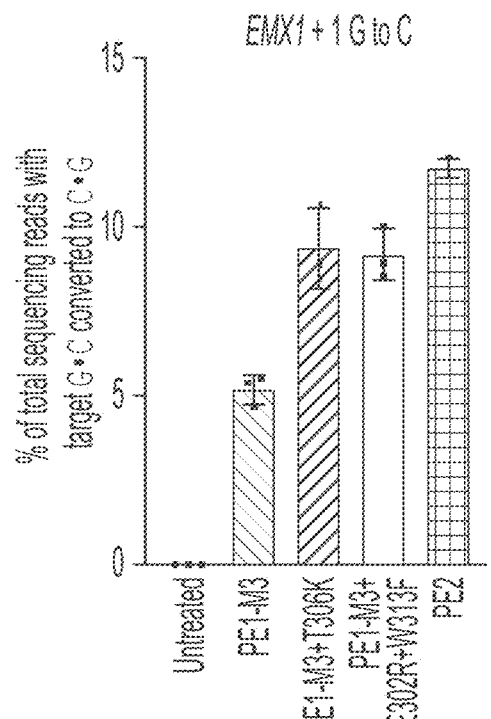
Figure 47M:
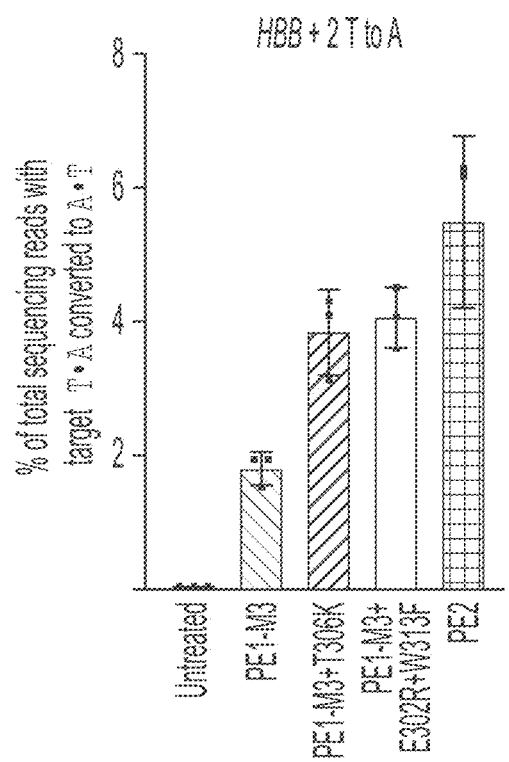
Figure 47N:
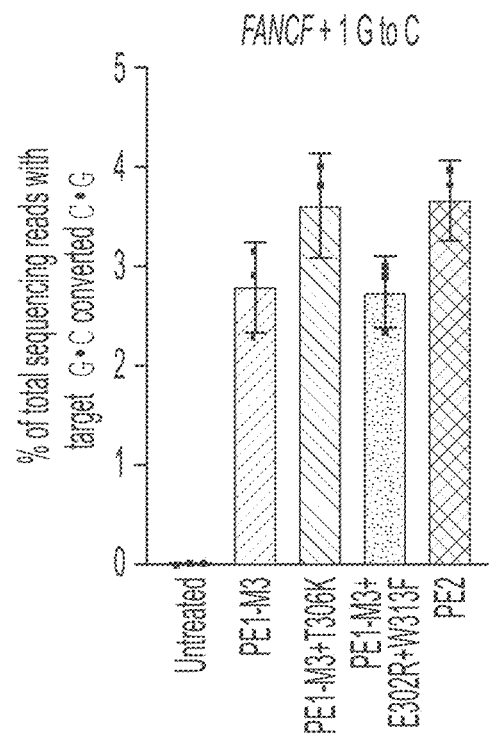
Figure 47O:
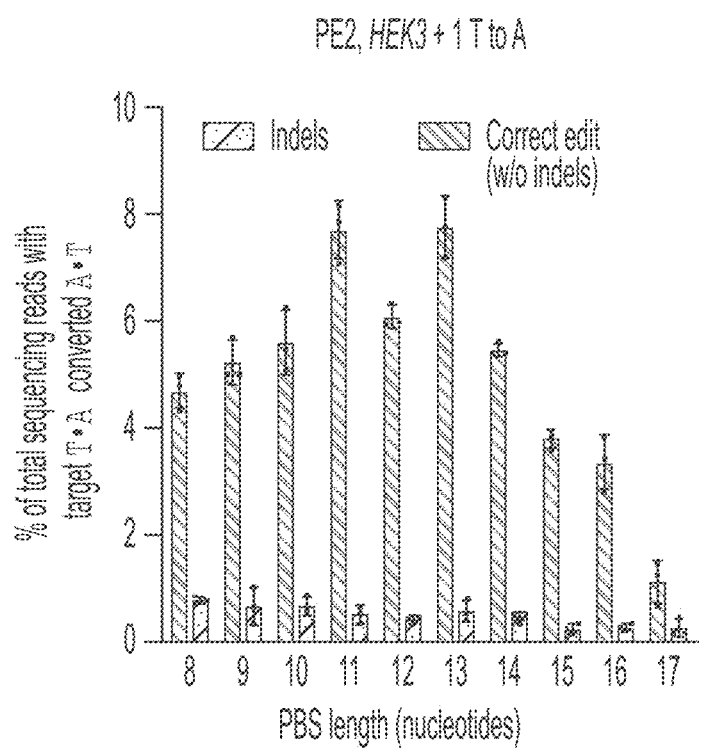
Figure 47P:
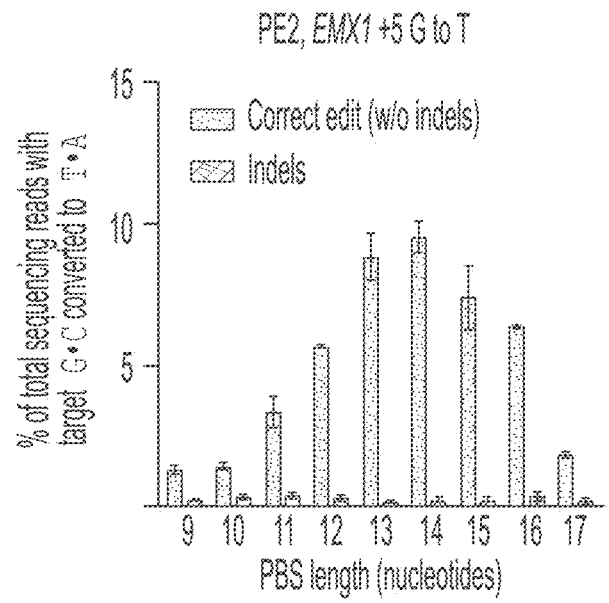
Figure 47Q:
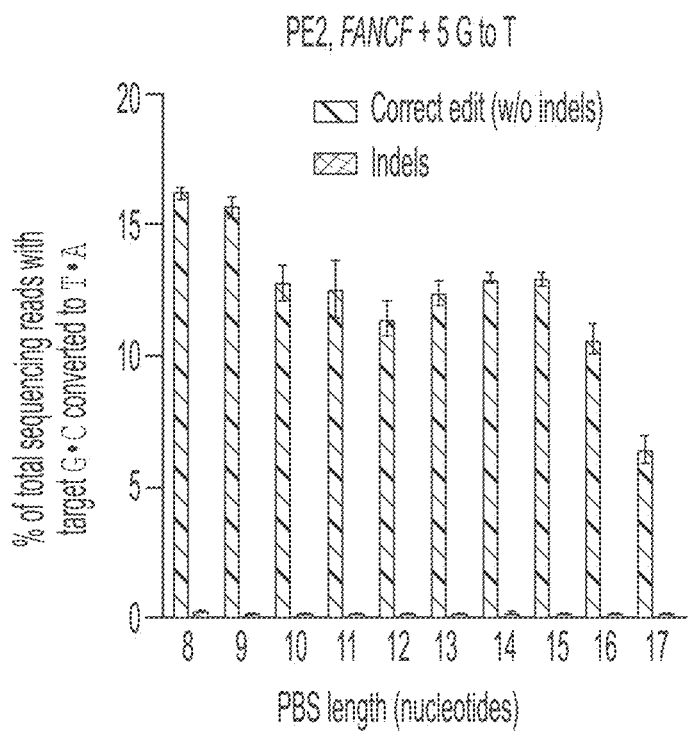
Figure 47R:
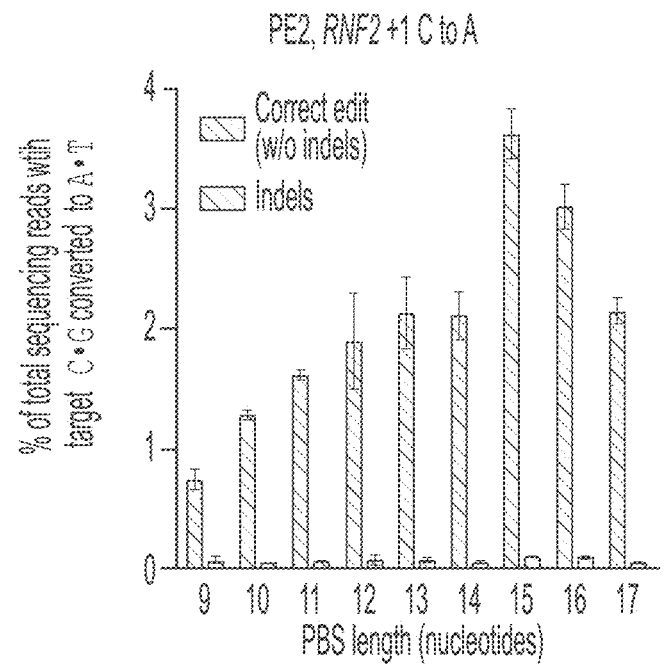
Figure 47S:
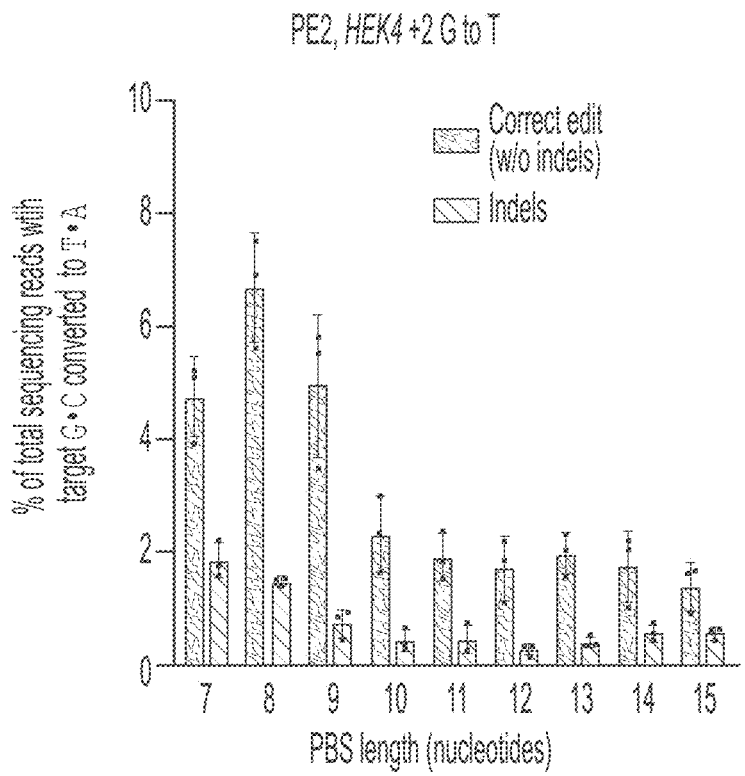

FIGS. 47A-47S show the evaluation of M-MLV RT variants for prime editing. FIG. 47A shows the abbreviations for prime editor variants used in this figure. FIG. 47B shows targeted insertion and deletion edits with PE1 at the HEK3 locus. FIGS. 47C-47H show a comparison of 18 prime editor constructs containing M-MLV RT variants for their ability to install a +2 G.C-to-C.G transversion edit at HEK3 as shown in FIG. 47C, a 24-bp FLAG insertion at HEK3 as shown in FIG. 47D, a +1 C.G-to-A.T transversion edit at RNF2 as shown in FIG. 47E, a +1 G.C-to-C.G transversion edit at EMX1 as shown in FIG. 47F, a +2 T.A-to-A.T transversion edit at HBB as shown in FIG. 47G, and a +1 G.C-to-C.G transversion edit at FANCF as shown in FIG. 47H. FIGS. 47I-47N show a comparison of four prime editor constructs containing M-MLV variants for their ability to install the edits shown in FIGS. 47C-47H in a second round of independent experiments. FIGS. 47O-47S show PE2 editing efficiency at five genomic loci with varying PBS lengths. FIG. 47O shows a +1 T.A-to-A.T variation at HEK3. FIG. 47P shows a +5 G.C-to-T.A variation at EMX1. FIG. 47Q shows a +5 G.C-to-T.A variation at FANCF. FIG. 47R shows a +1 C.G-to-A.T variation at RNF2. FIG. 47S shows a +2 G.C-to-T.A variation at HEK4. Values and error bars reflect the mean and s.d. of three independent biological replicates.

Figure 48A:
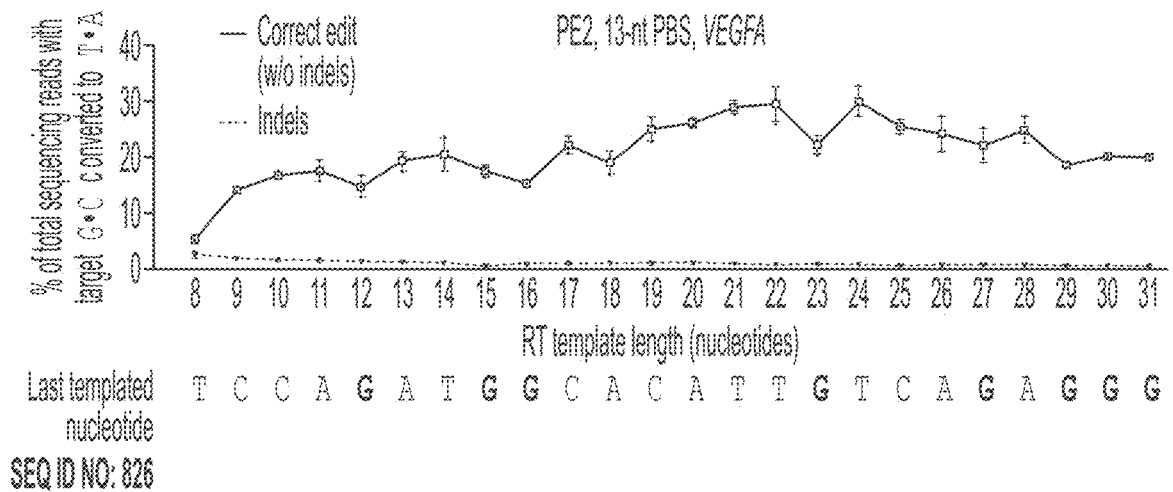
Figure 48B:
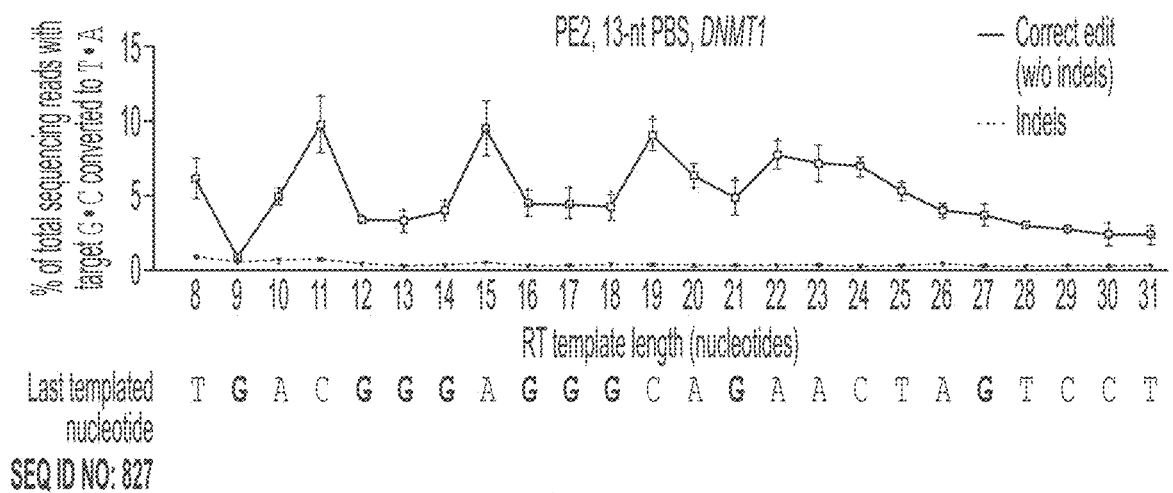
Figure 48C:
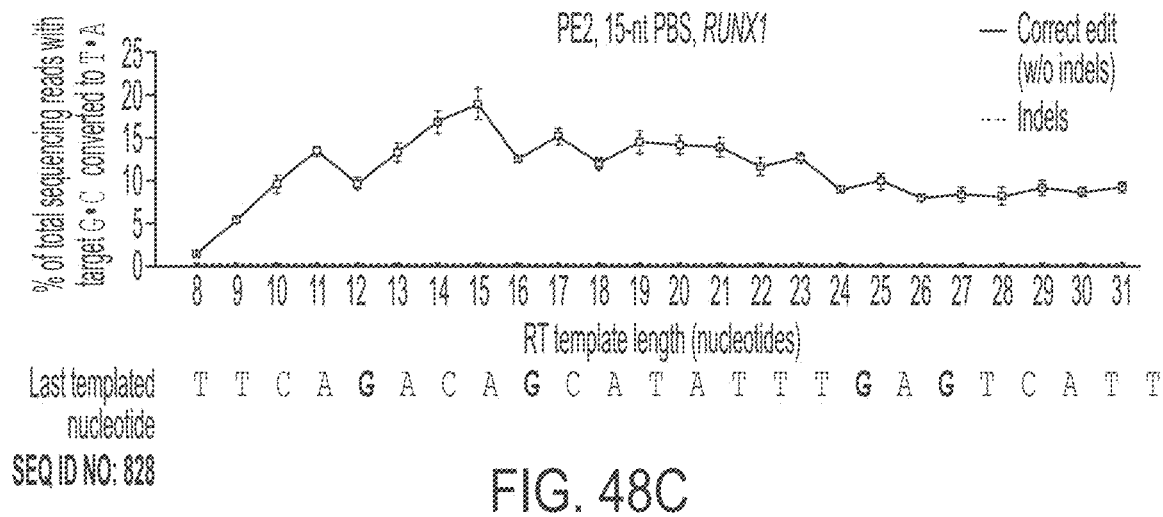

FIGS. 48A-48C show design features of PEgRNA PBS and RT template sequences. FIG. 48A shows PE2-mediated +5 G.C-to-T.A transversion editing efficiency (blue line) at VEGFA in HEK293T cells as a function of RT template length. Indels (gray line) are plotted for comparison. The sequence below the graph shows the last nucleotide templated for synthesis by the PEgRNA. G nucleotides (templated by a C in the PEgRNA) are highlighted; RT templates that end in C should be avoided during PEgRNA design to maximize prime editing efficiencies. FIG. 48B shows +5 G.C-to-T.A transversion editing and indels for DNMT1 as in FIG. 48A. FIG. 48C shows +5 G.C-to-T.A transversion editing and indels for RUNX1 as in FIG. 48A. Values and error bars reflect the mean and s.d. of three independent biological replicates.

Figure 49A:
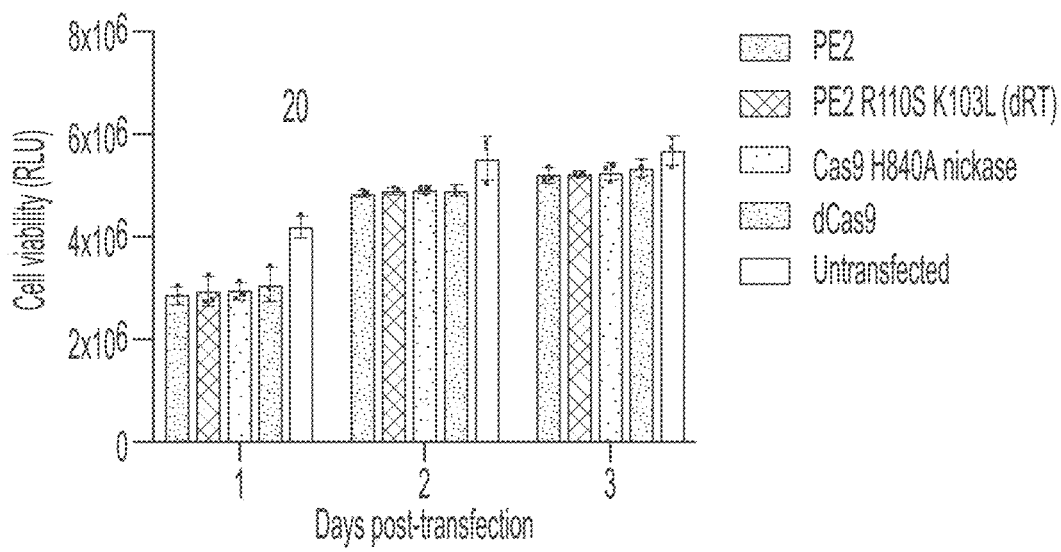
Figure 49B:
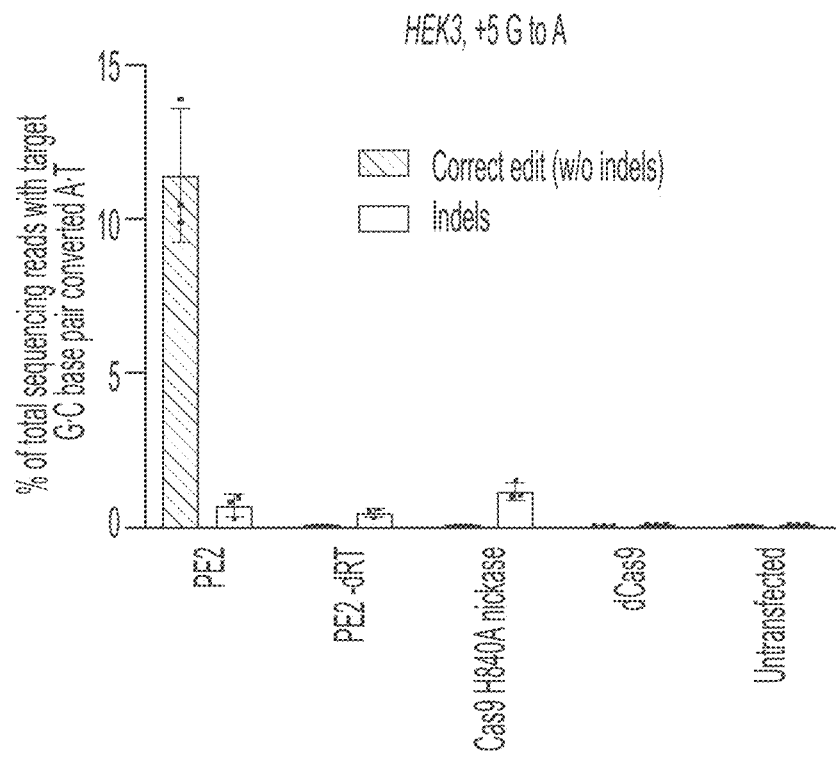

FIGS. 49A-49B show the effects of PE2, PE2 R110S K103L, Cas9 H840A nickase, and dCas9 on cell viability. HEK293T cells were transfected with plasmids encoding PE2, PE2 R110S K103L, Cas9 H840A nickase, or dCas9, together with a HEK3-targeting PEgRNA plasmid. Cell viability was measured every 24 hours post-transfection for 3 days using the CellTiter-Glo 2.0 assay (Promega). FIG. 49A shows viability, as measured by luminescence, at 1, 2, or 3 days post-transfection. Values and error bars reflect the mean and s.e.m. of three independent biological replicates each performed in technical triplicate. FIG. 49B shows percent editing and indels for PE2, PE2 R110S K103L, Cas9 H840A nickase, or dCas9, together with a HEK3-targeting PEgRNA plasmid that encodes a +5 G to A edit. Editing efficiencies were measured on day 3 post-transfection from cells treated alongside of those used for assaying viability in FIG. 49A. Values and error bars reflect the mean and s.d. of three independent biological replicates.

Figure 50A:
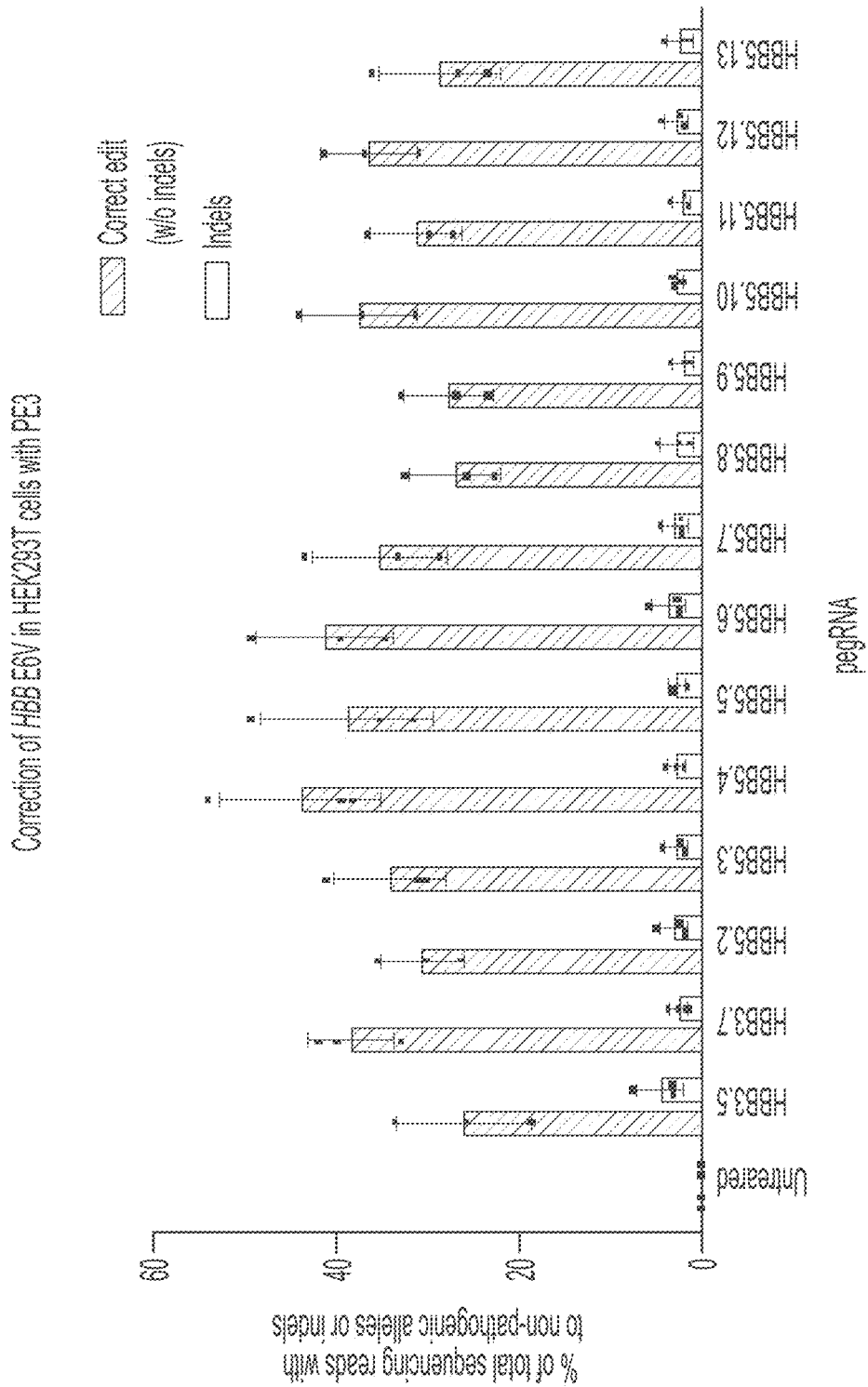
Figure 50B:
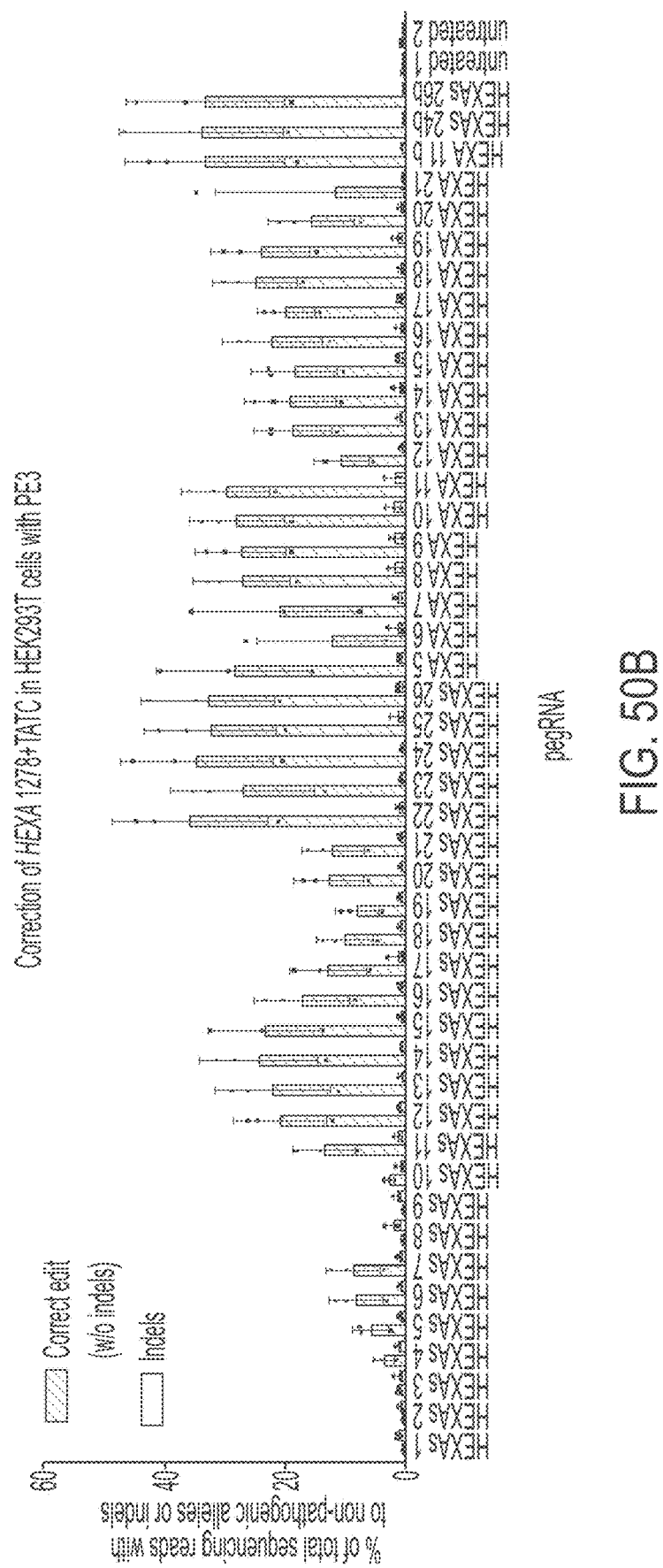

FIGS. 50A-50B show PE3-mediated HBB E6V correction and HEXA 1278+TATC correction by various PEgRNAs. FIG. 50A shows a screen of 14 PEgRNAs for correction of the HBB E6V allele in HEK293T cells with PE3. All PEgRNAs evaluated convert the HBB E6V allele back to wild-type HBB without the introduction of any silent PAM mutation. FIG. 50B shows a screen of 41 PEgRNAs for correction of the HEXA 1278+TATC allele in HEK293T cells with PE3 or PE3b. Those PEgRNAs labeled HEXAs correct the pathogenic allele by a shifted 4-bp deletion that disrupts the PAM and leaves a silent mutation. Those PEgRNAs labeled HEXA correct the pathogenic allele back to wild-type. Entries ending in "b" use an edit-specific nicking sgRNA in combination with the PEgRNA (the PE3b system). Values and error bars reflect the mean and s.d. of three independent biological replicates.

Figure 51A:
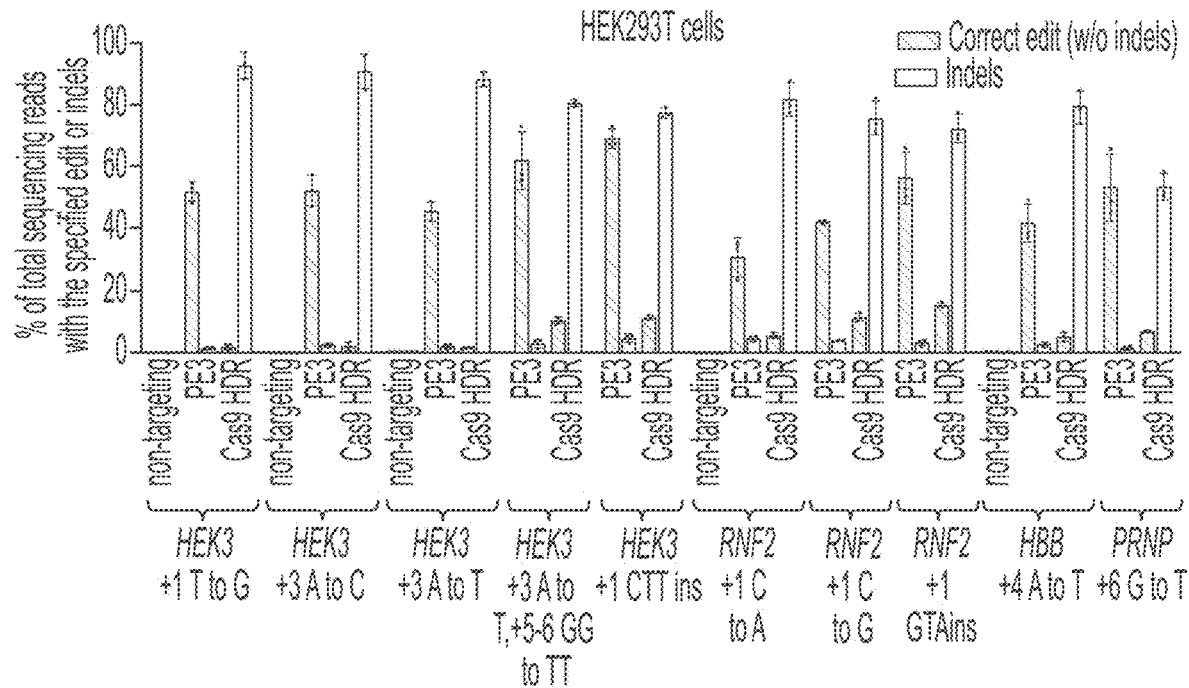
Figure 51B:
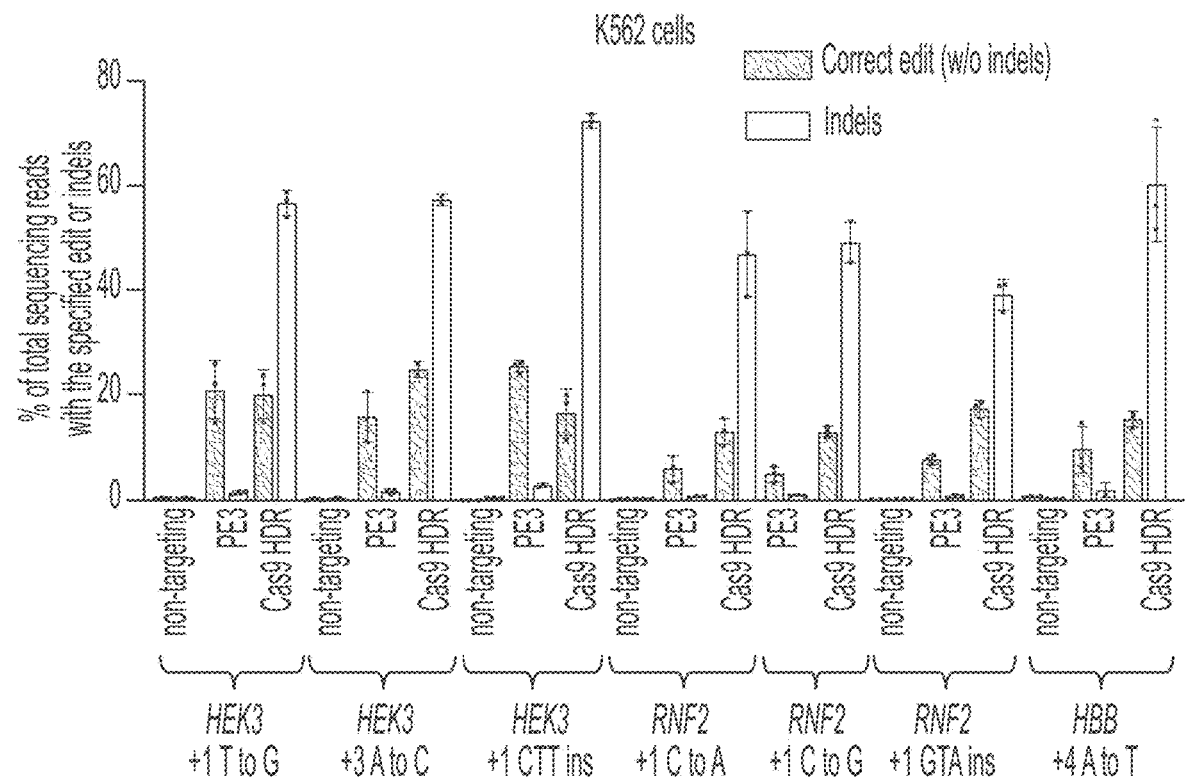
Figure 51C:
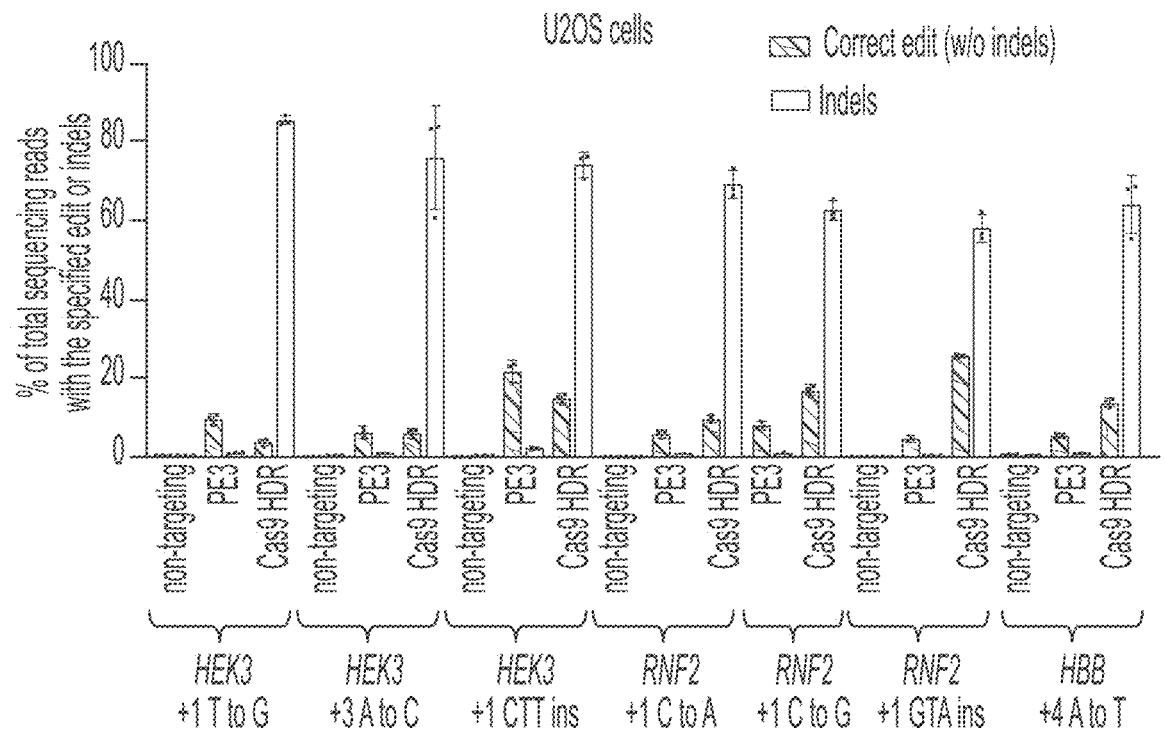
Figure 51D:
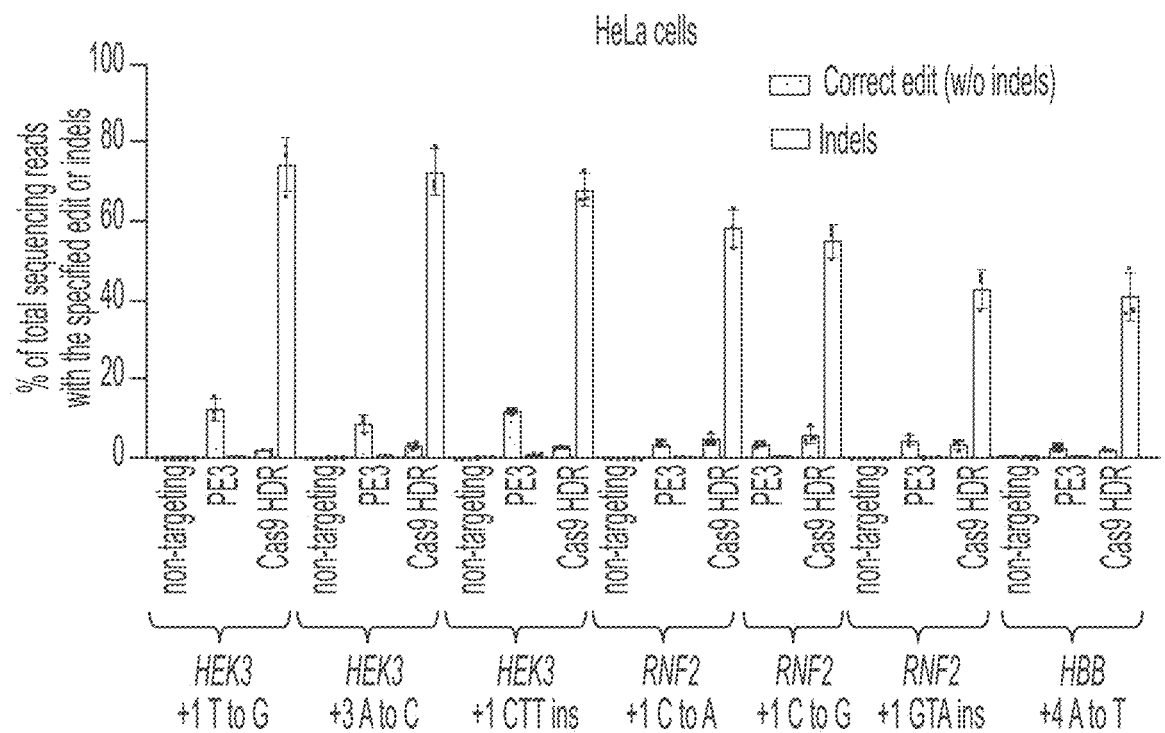
Figure 51E:
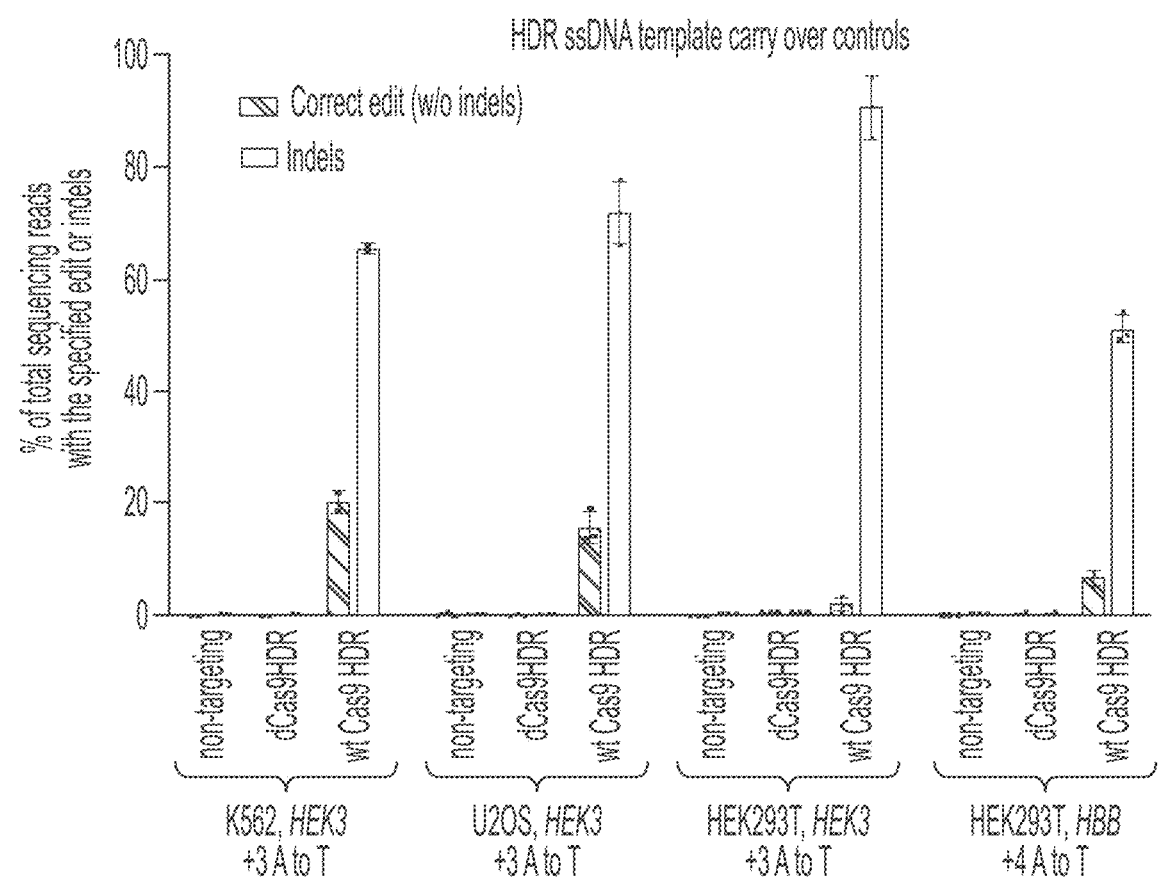
Figure 51F:
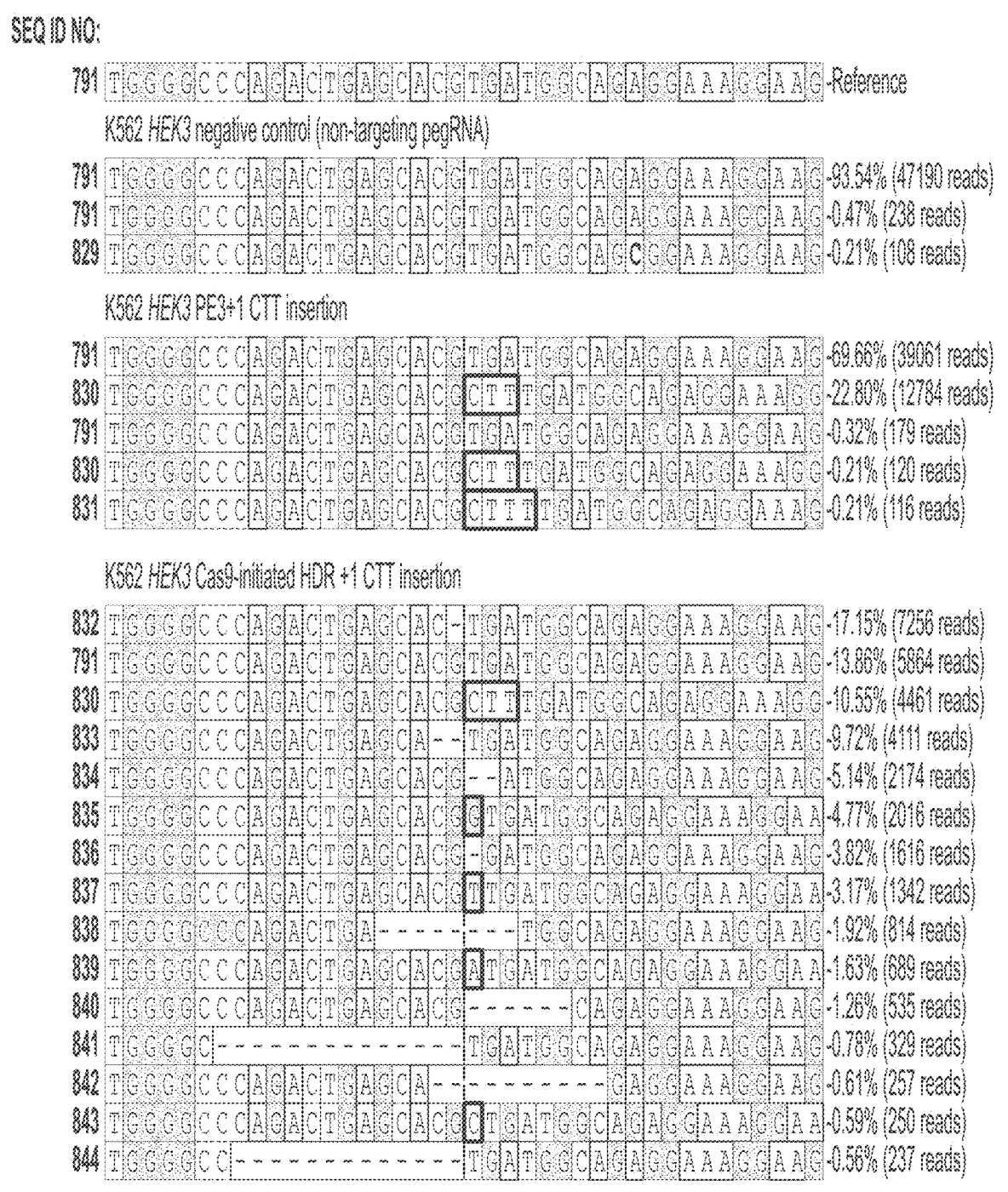
Figure 51G:
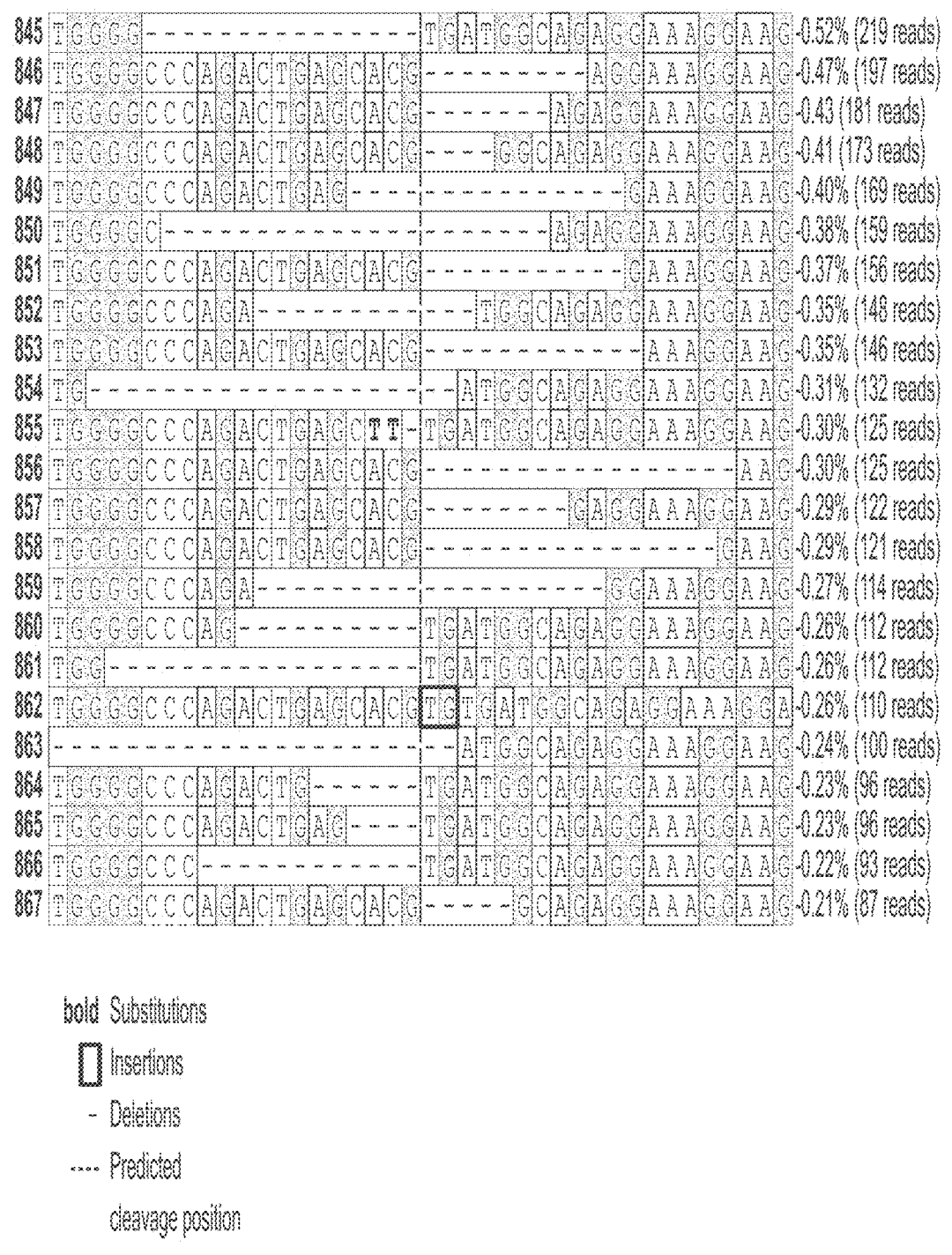
Figure 52A:
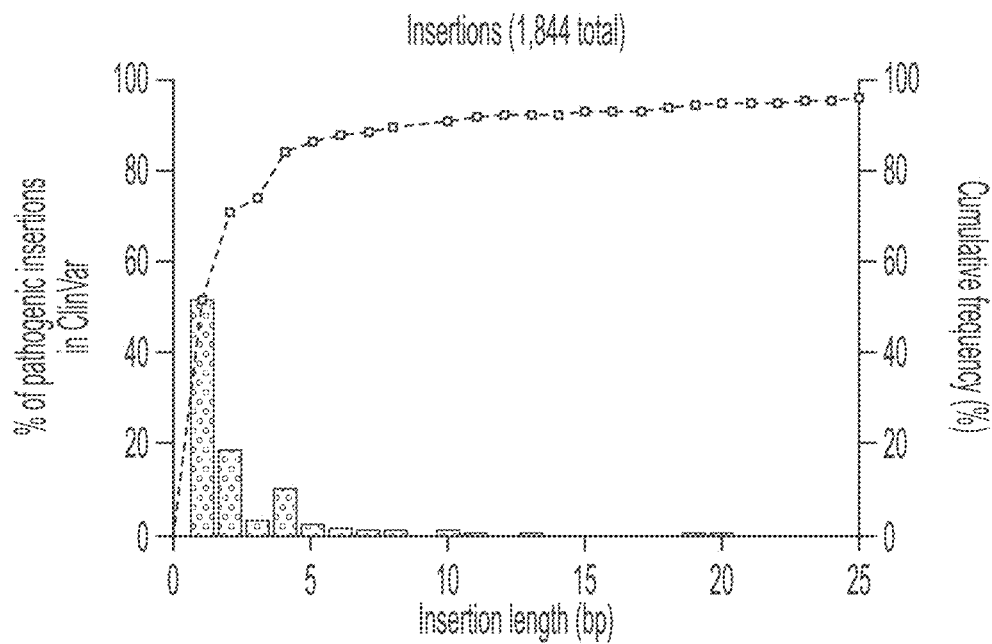
Figure 52B:
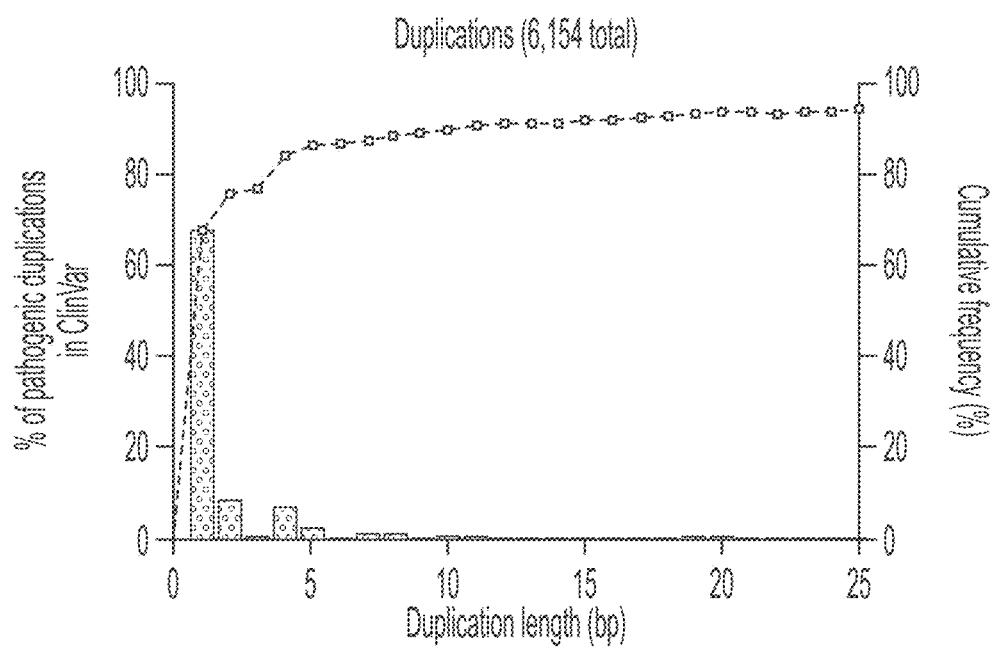
Figure 52C:
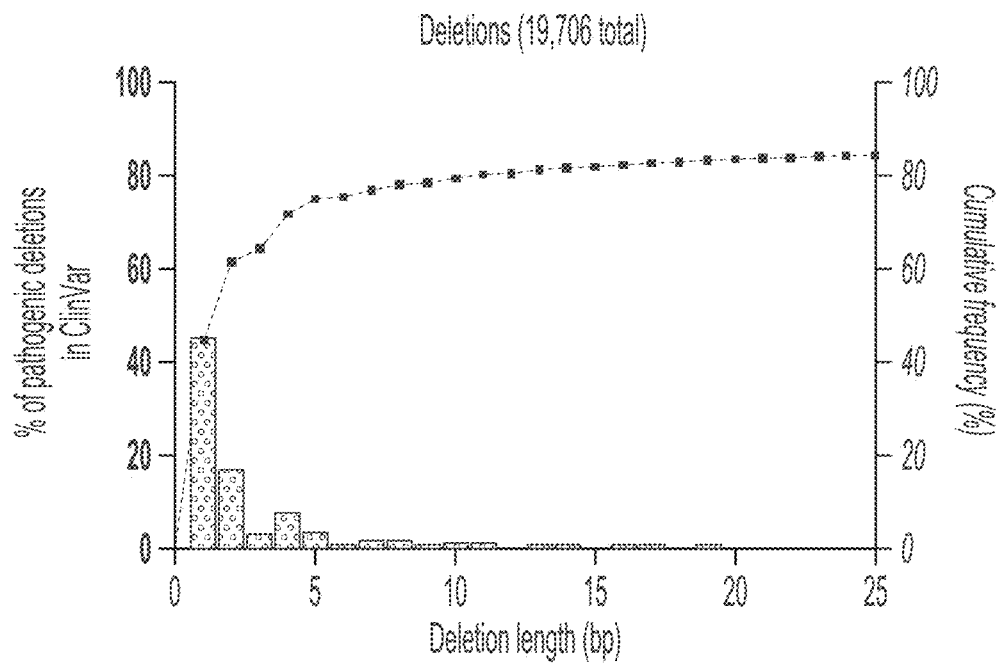
Figure 52D:
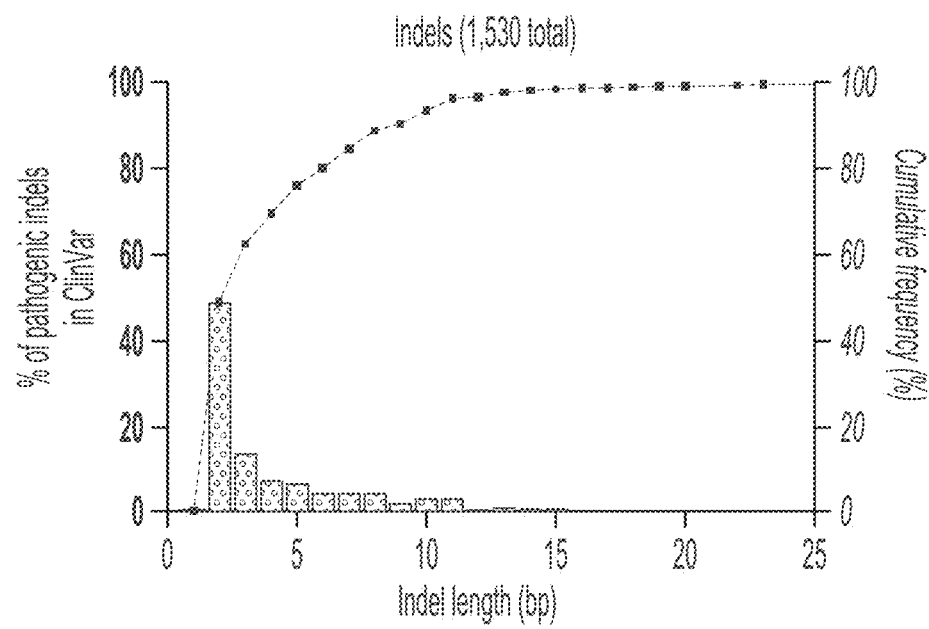

FIGS. 51A-51G show a PE3 activity in human cell lines and a comparison of PE3 and Cas9-initiated HDR. Efficiency of generating the correct edit (without indels) and indel frequency for PE3 and Cas9-initiated HDR in HEK293T cells as shown in FIG. 51A, K562 cells as shown in FIG. 51B, U2OS cells as shown in FIG. 51C, and HeLa cells as shown in FIG. 51D. Each bracketed editing comparison installs identical edits with PE3 and Cas9-initiated HDR. Non-targeting controls are PE3 and a PEgRNA that targets a non-target locus. FIG. 51E shows control experiments with non-targeting PEgRNA+PE3, and with dCas9+sgRNA, compared with wild-type Cas9 HDR experiments confirming that ssDNA donor HDR template, a common contaminant that artificially elevates apparent HDR efficiencies, does not contribute to the HDR measurements in FIGS. 51A-51D. FIGS. 51F-51G show example HEK3 site allele tables from genomic DNA samples isolated from K562 cells after editing with PE3 or with Cas9-initiated HDR. Alleles were sequenced on an Illumina MiSeq and analyzed with CRISPResso2[178]. The reference HEK3 sequence from this region is at the top. Allele tables are shown for a non-targeting PEgRNA negative control, a +1 CTT insertion at HEK3 using PE3, and a +1 CTT insertion at HEK3 using Cas9-initiated HDR. Allele frequencies and corresponding Illumina sequencing read counts are shown for each allele. All alleles observed with frequency ≥0.20% are shown. Values and error bars reflect the mean and s.d. of three independent biological replicates.

FIGS. 52A-52D show distribution by length of pathogenic insertions, duplications, deletions, and indels in the ClinVar database. The ClinVar variant summary was downloaded from NCBI Jul. 15, 2019. The lengths of reported insertions, deletions, and duplications were calculated using reference and alternate alleles, variant start and stop positions, or appropriate identifying information in the variant name. Variants that did not report any of the above information were excluded from the analysis. The lengths of reported indels (single variants that include both insertions and deletions relative to the reference genome) were calculated by determining the number of mismatches or gaps in the best pairwise alignment between the reference and alternate alleles.

Figure 53A:
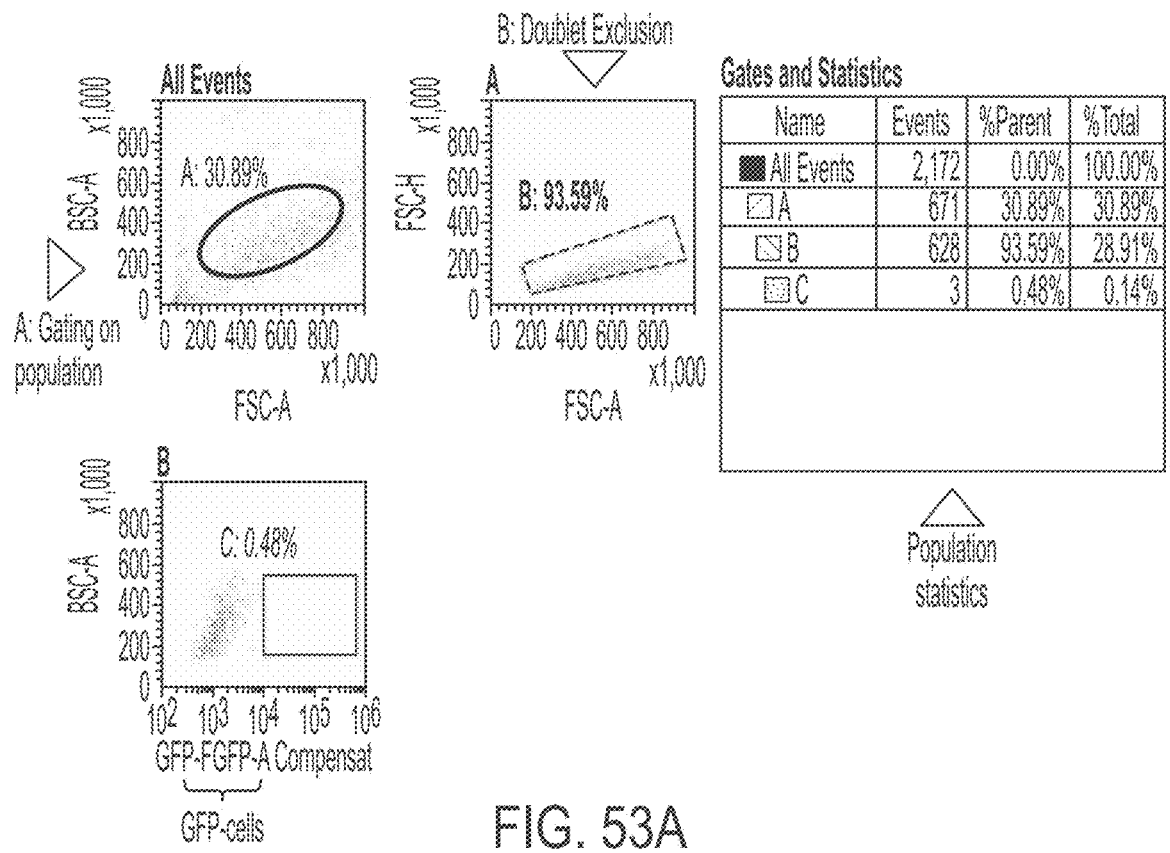
Figure 53B:
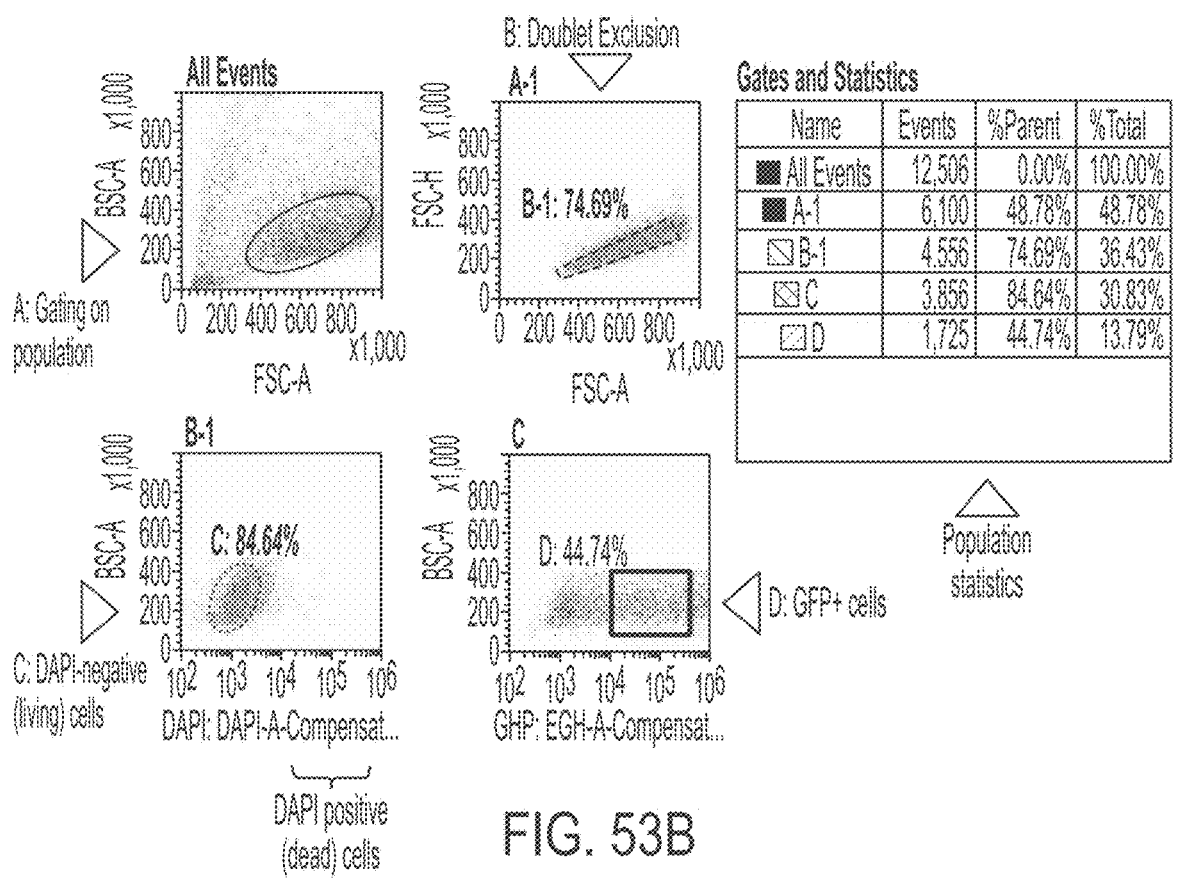
Figure 53C:
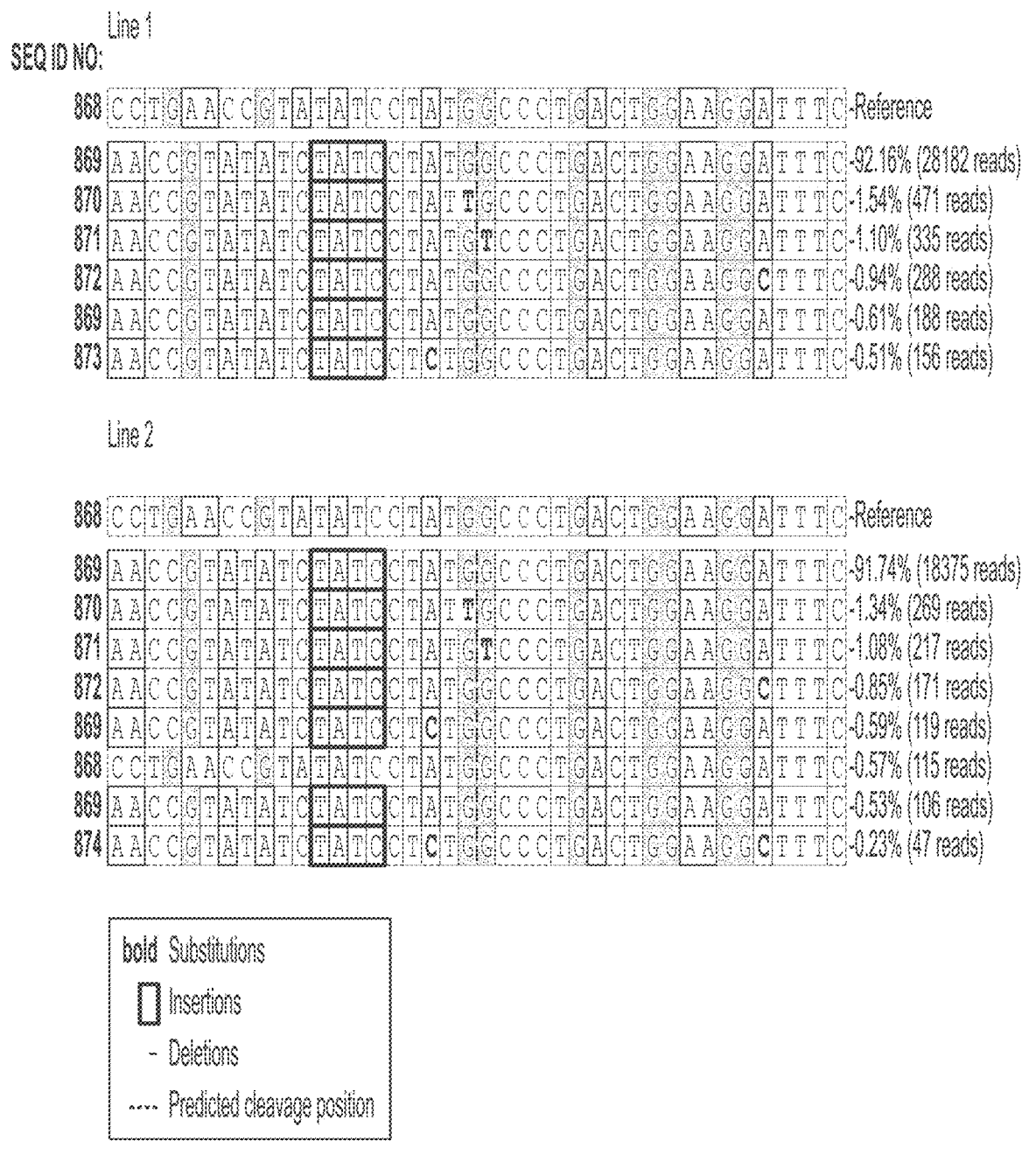
Figure 53E:
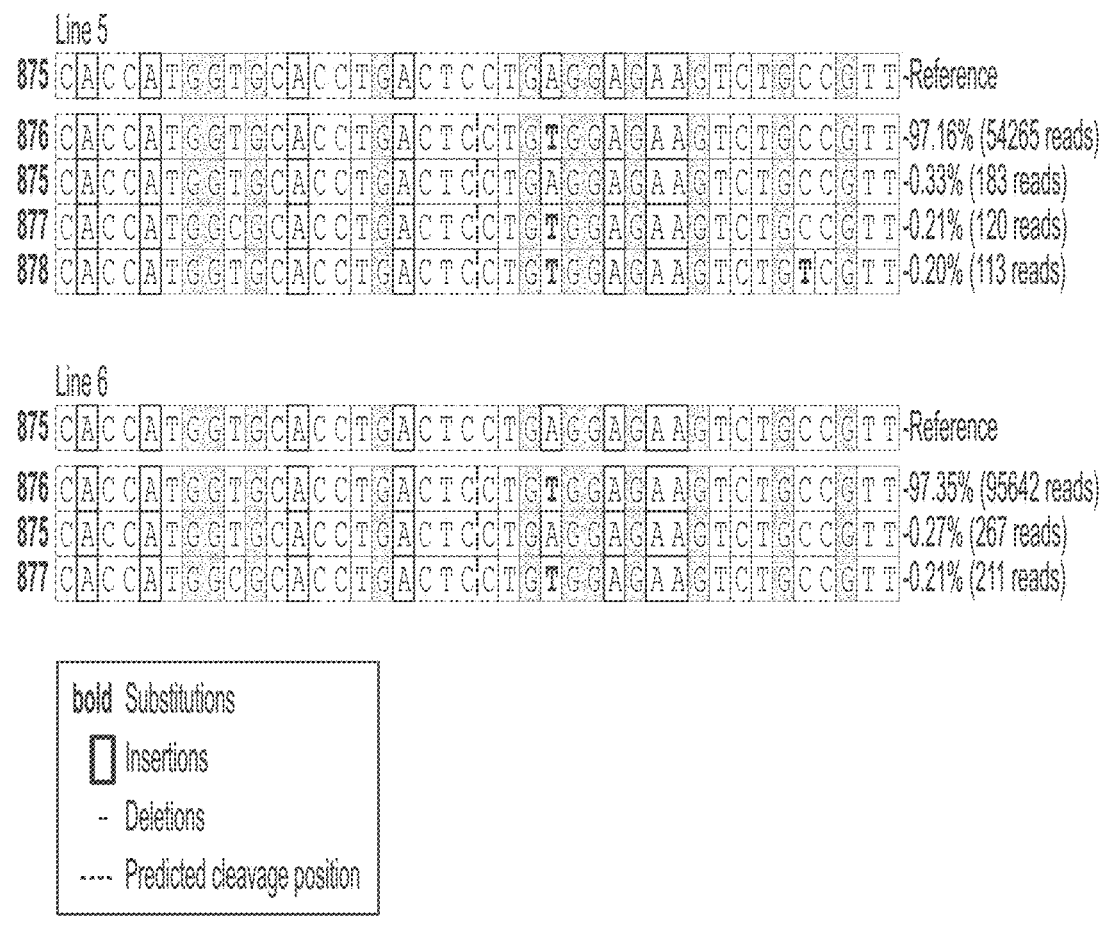

FIGS. 53A-53E show FACS gating examples for GFP-positive cell sorting. Below are examples of original batch analysis files outlining the sorting strategy used for generating HEXA 1278+TATC and HBB E6V HEK293T cell lines. The image data was generated on a Sony LE-MA900 cytometer using Cell Sorter Software v. 3.0.5. Graphic 1 shows gating plots for cells that do not express GFP. Graphic 2 shows an example sort of P2A-GFP-expressing cells used for isolating the HBB E6V HEK293T cell lines. HEK293T cells were initially gated on population using FSC-A/BSC-A (Gate A), then sorted for singlets using FSC-A/FSC-H (Gate B). Live cells were sorted for by gating DAPI-negative cells (Gate C). Cells with GFP fluorescence levels that were above those of the negative-control cells were sorted for using EGFP as the fluorochrome (Gate D). FIG. 53A shows HEK293T cells (GFP-negative). FIG. 53B shows a representative plot of FACS gating for cells expressing PE2-P2A-GFP. FIG. 53C shows the genotypes for HEXA 1278+TATC homozygote HEK293T cells. FIGS. 53D-53E show allele tables for HBB E6V homozygote HEK293T cell lines.

FIG. 54 is a schematic which summarizes the PEgRNA cloning procedure.

Figure 55A:
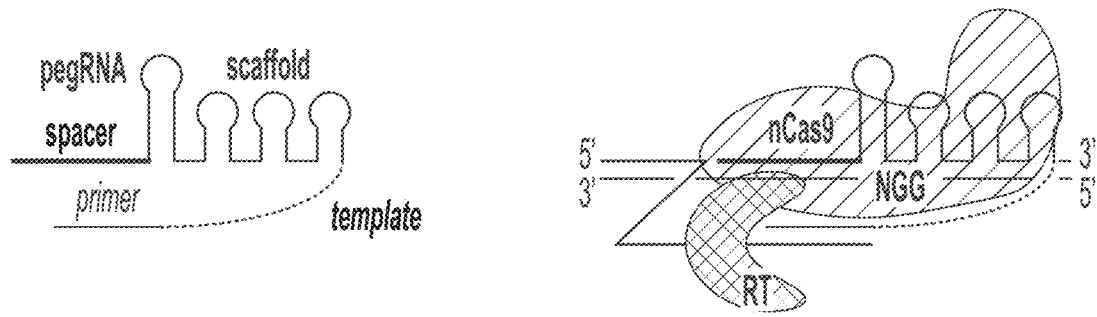
Figure 55B:
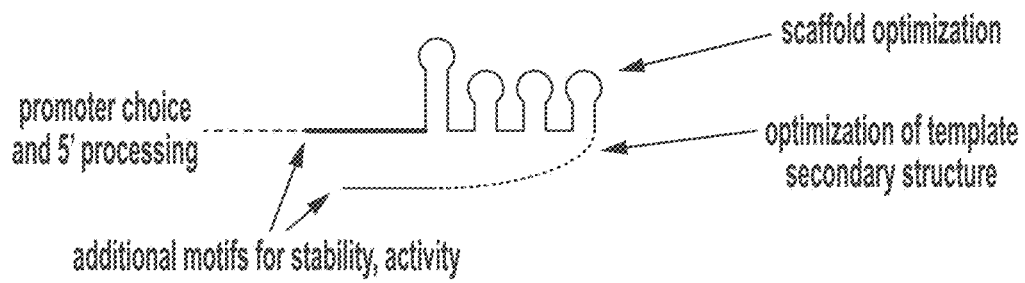
Figure 55C:
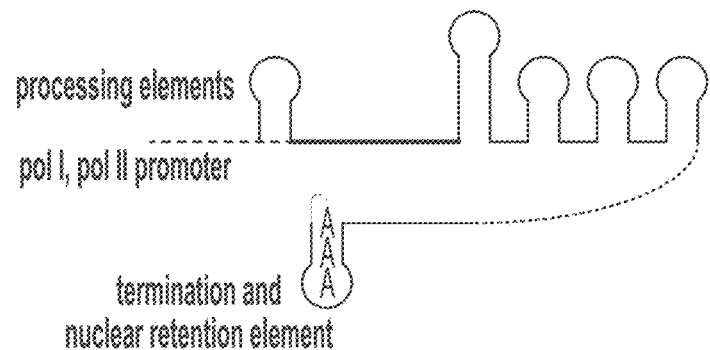
Figure 55D:
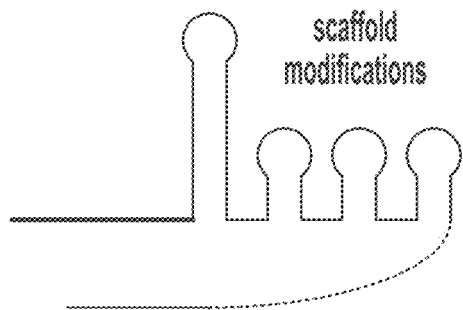
Figure 55E:
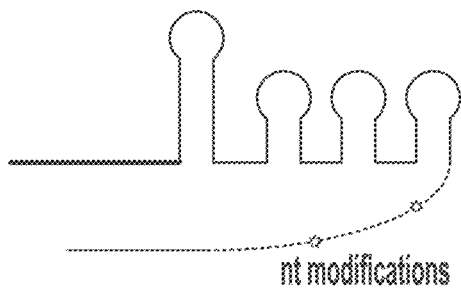
Figure 55F:
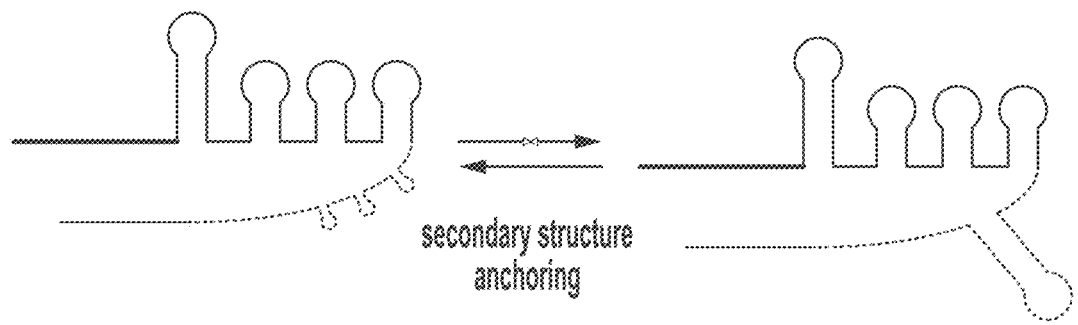
Figure 55G:
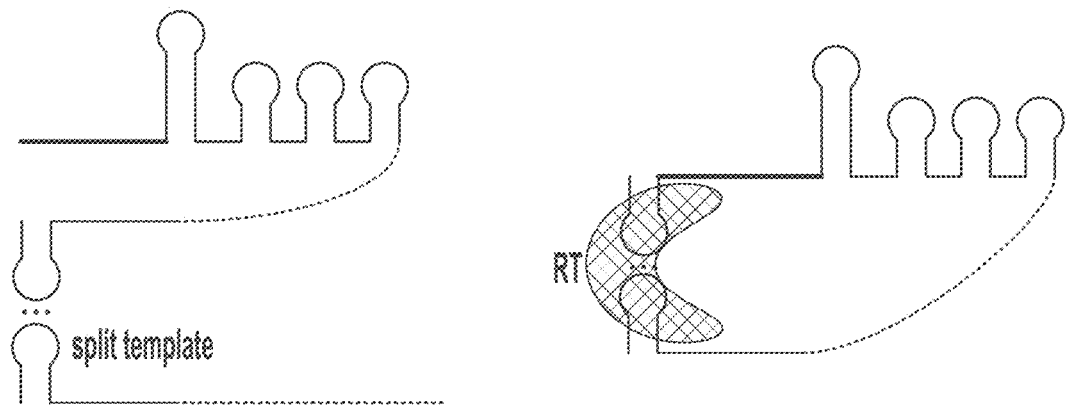

FIGS. 55A-55G are schematics of PEgRNA designs. FIG. 55A shows a simple diagram of PEgRNA with domains labeled (left) and bound to nCas9 at a genomic site (right). FIG. 55B shows various types of modifications to PEgRNA which are anticipated to increase activity. FIG. 55C shows modifications to PEgRNA to increase transcription of longer RNAs via promoter choice and 5', 3' processing and termination. FIG. 55D shows the lengthening of the P1 system, which is an example of a scaffold modification. FIG. 55E shows that the incorporation of synthetic modifications within the template region, or elsewhere within the PEgRNA, could increase activity. FIG. 55F shows that a designed incorporation of minimal secondary structure within the template could prevent formation of longer, more inhibitory, secondary structure. FIG. 55G shows a split PEgRNA with a second template sequence anchored by an RNA element at the 3' end of the PEgRNA (left). Incorporation of elements at the 5' or 3' ends of the PEgRNA could enhance RT binding.

Figure 56A:
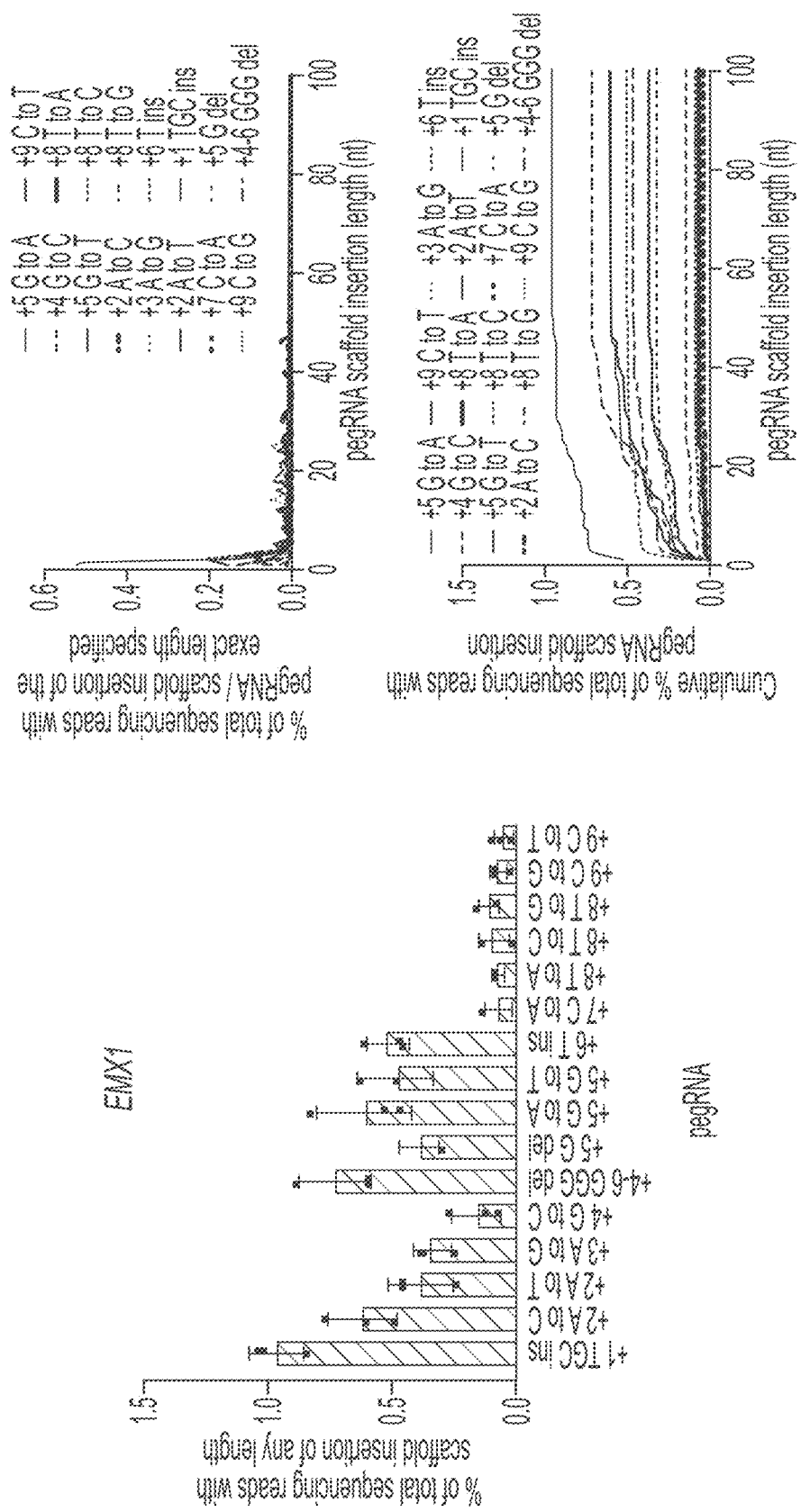
Figure 56C:
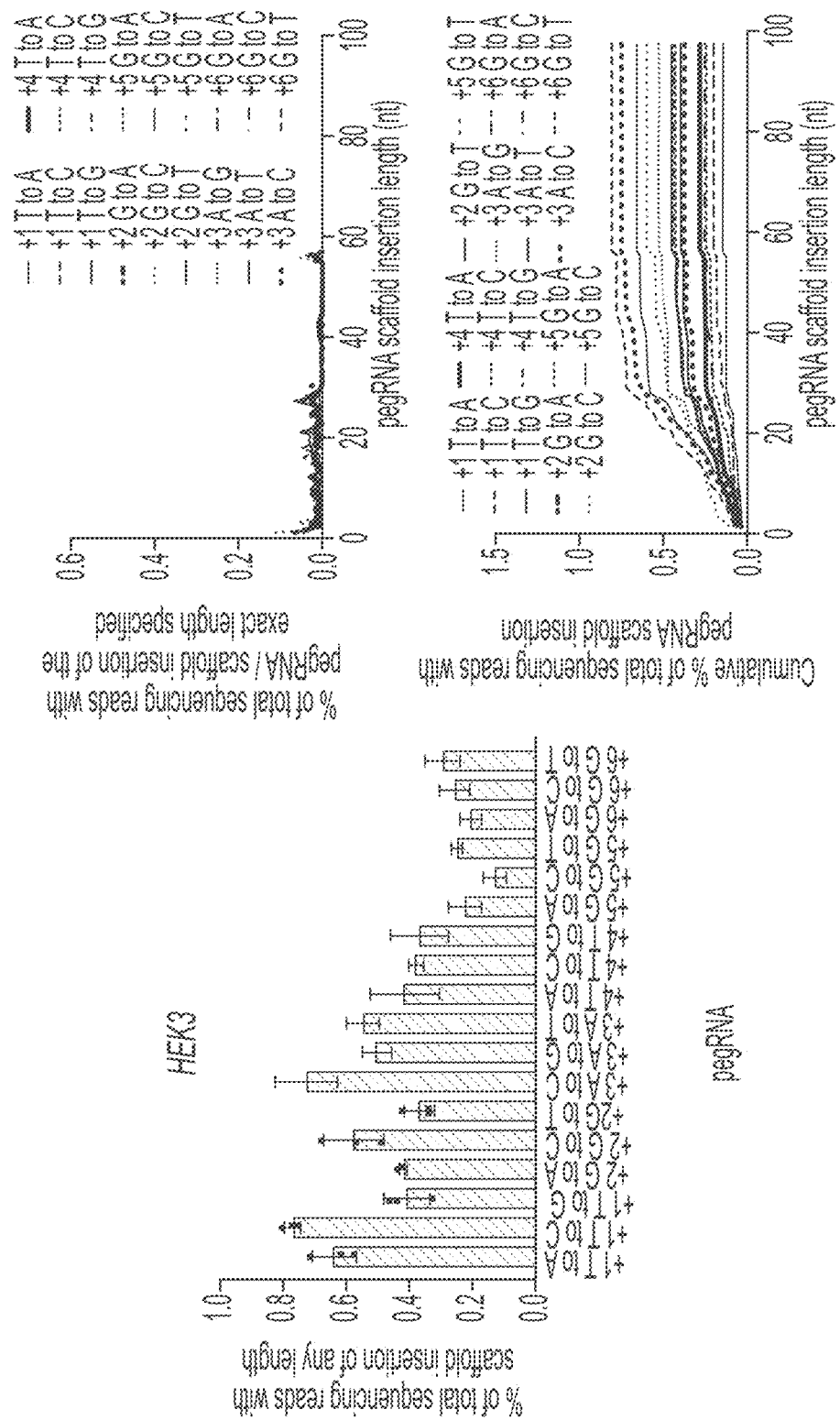

FIGS. 56A-56D show the incorporation of PEgRNA scaffold sequence into target loci. HTS data were analyzed for PEgRNA scaffold sequence insertion as described in FIGS. 60A-60B. FIG. 56A shows an analysis for the EMX1 locus. Shown is the % of total sequencing reads containing one or more PEgRNA scaffold sequence nucleotides within an insertion adjacent to the RT template (left); the percentage of total sequencing reads containing a PEgRNA scaffold sequence insertion of the specified length (middle); and the cumulative total percentage of PEgRNA insertion up to and including the length specified on the X axis. FIG. 56B shows the same as FIG. 56A, but for FANCF. FIG. 56C shows the same as in FIG. 56A but for HEK3. FIG. 56D shows the same as FIG. 56A but for RNF2. Values and error bars reflect the mean and s.d. of three independent biological replicates.

Figure 57A:
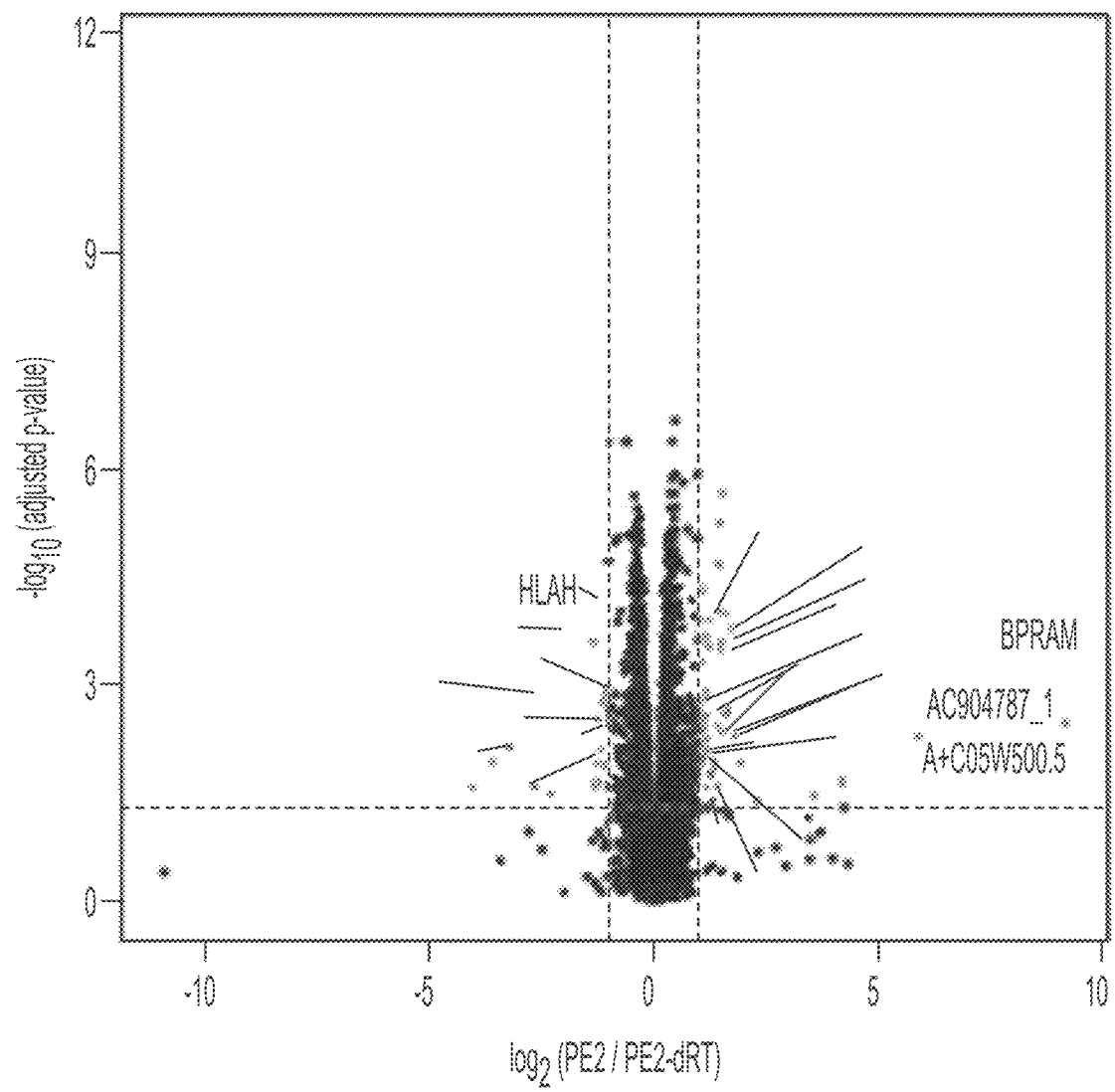
Figure 57B:
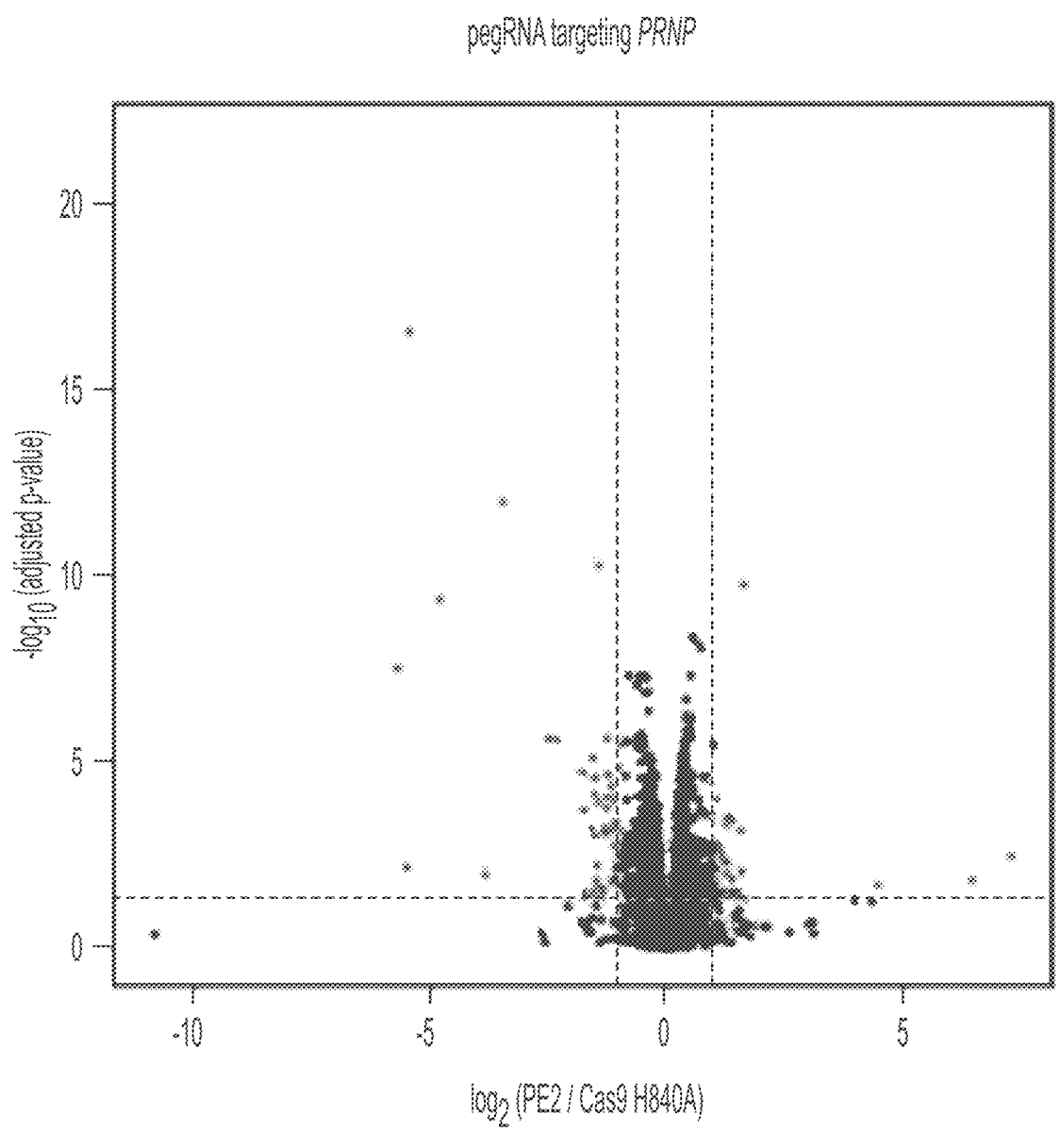
Figure 57C:
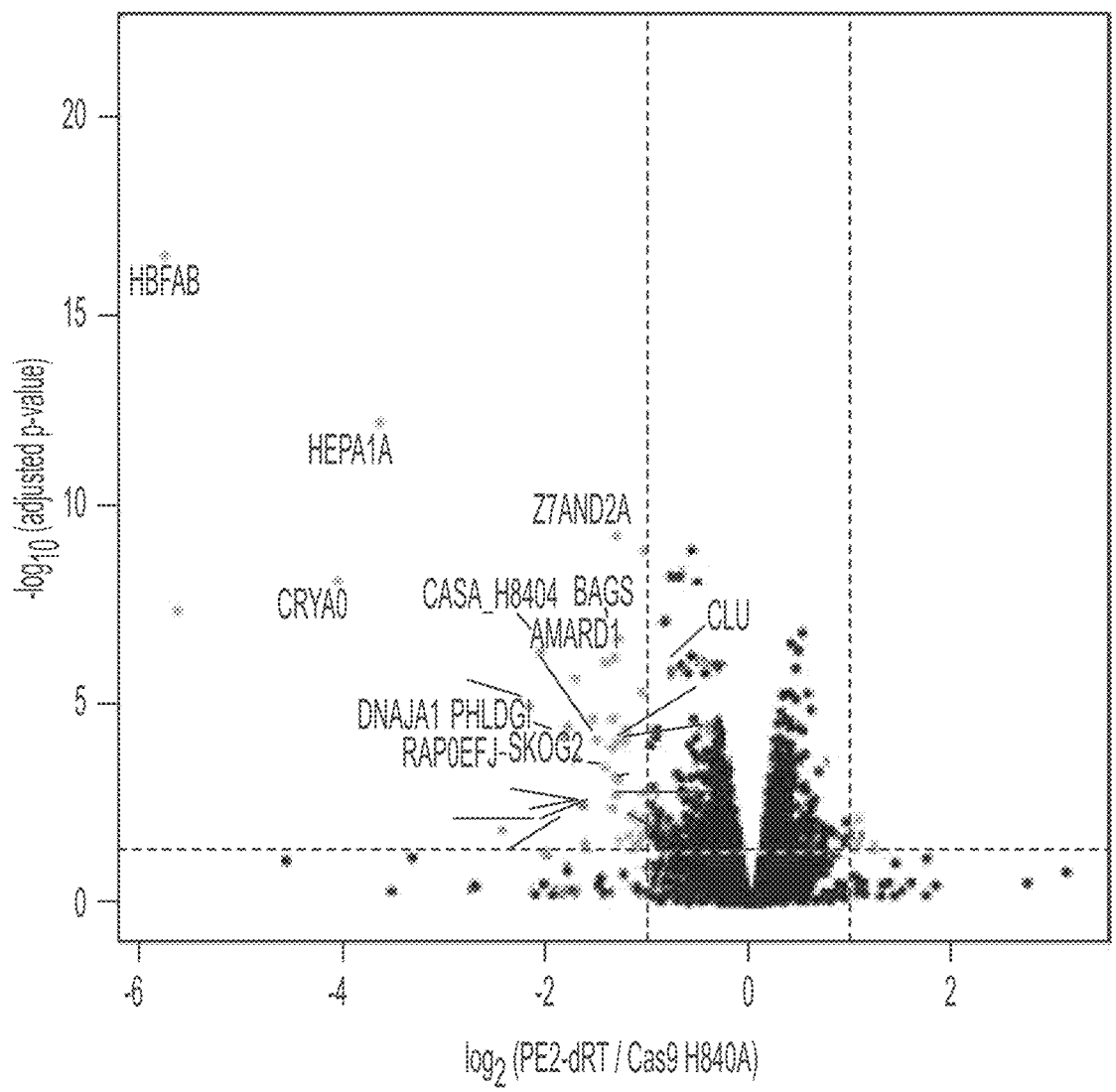
Figure 57D:
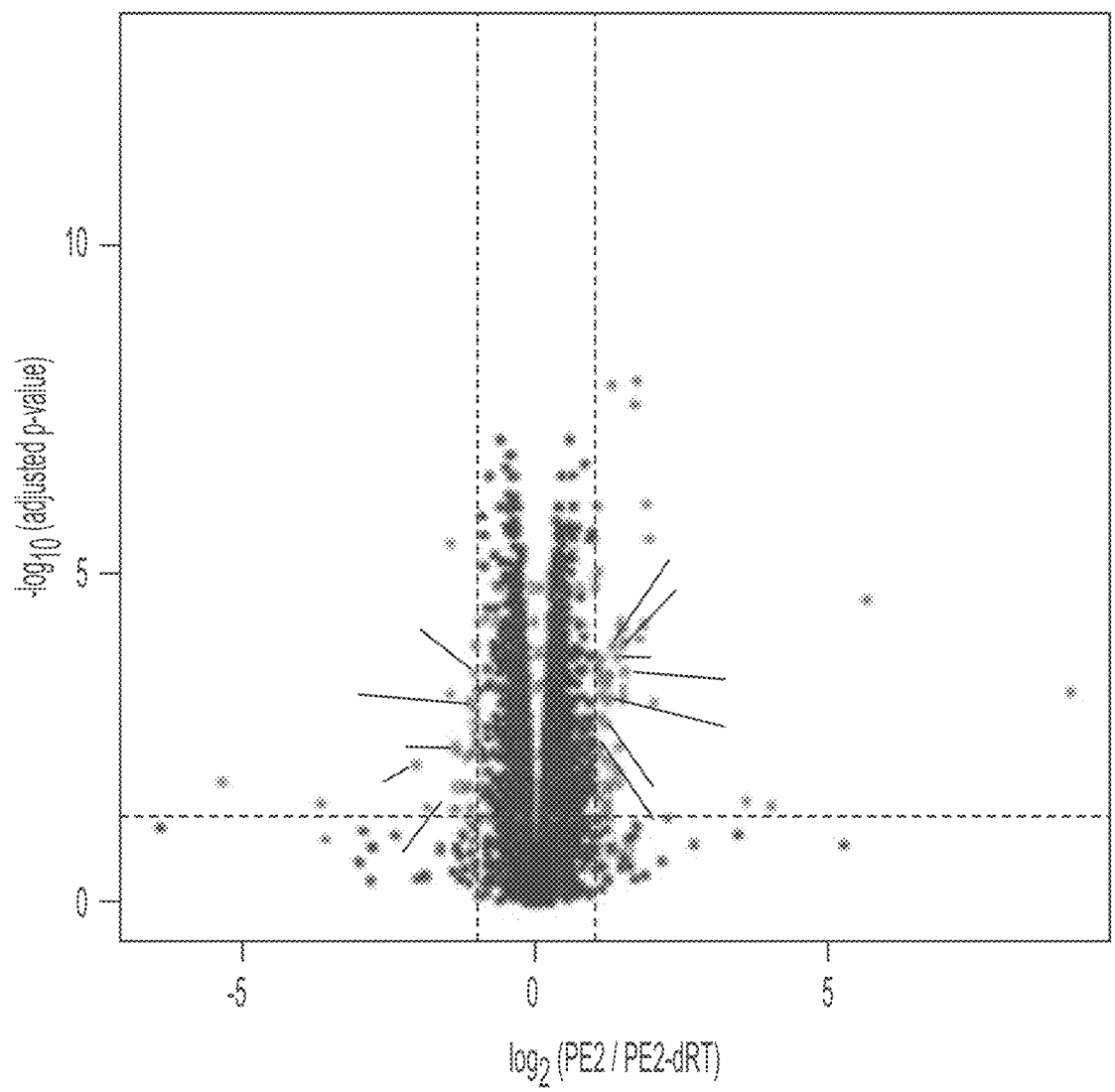
Figure 57E:
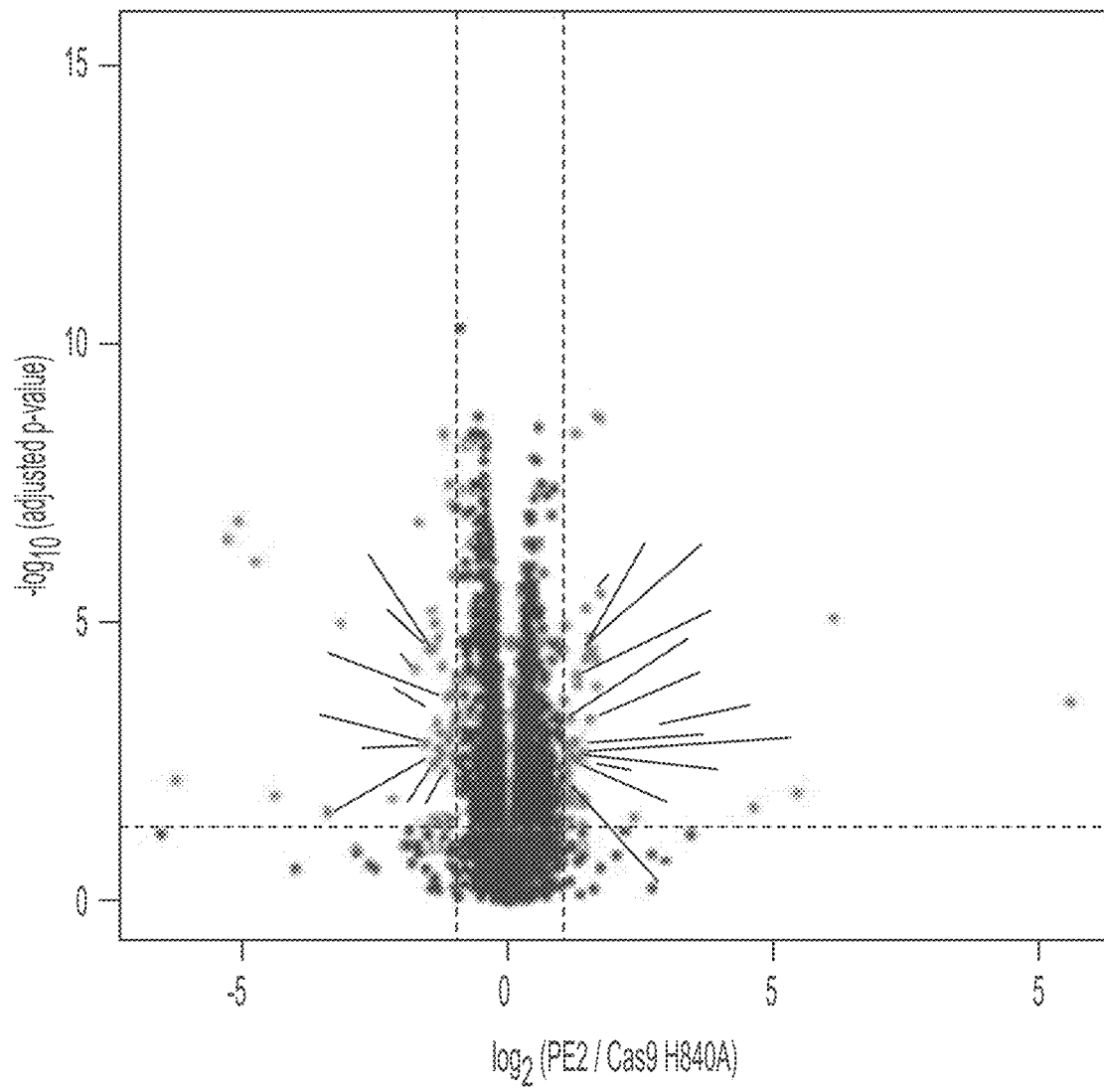
Figure 57F:
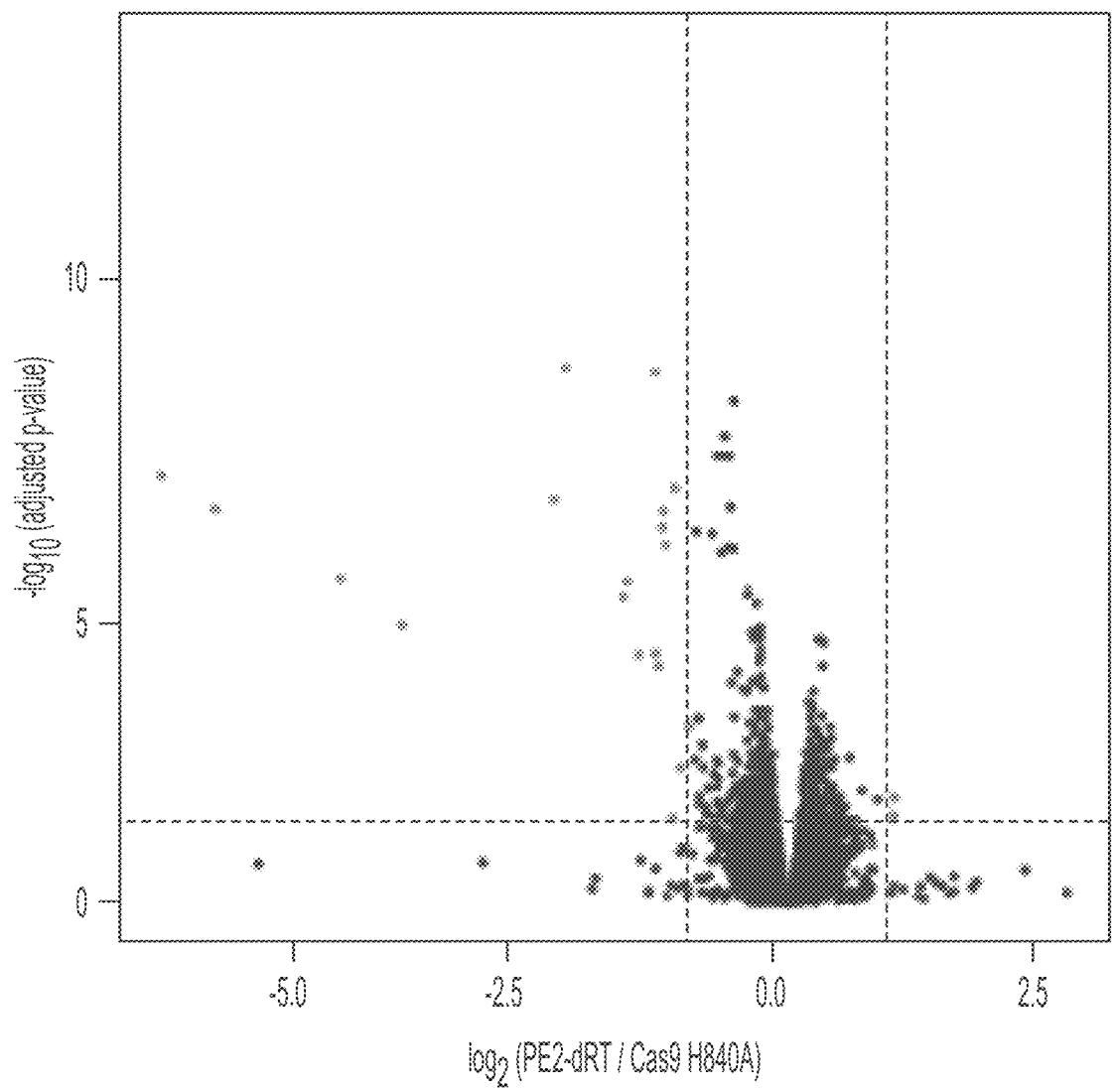
Figure 57G:
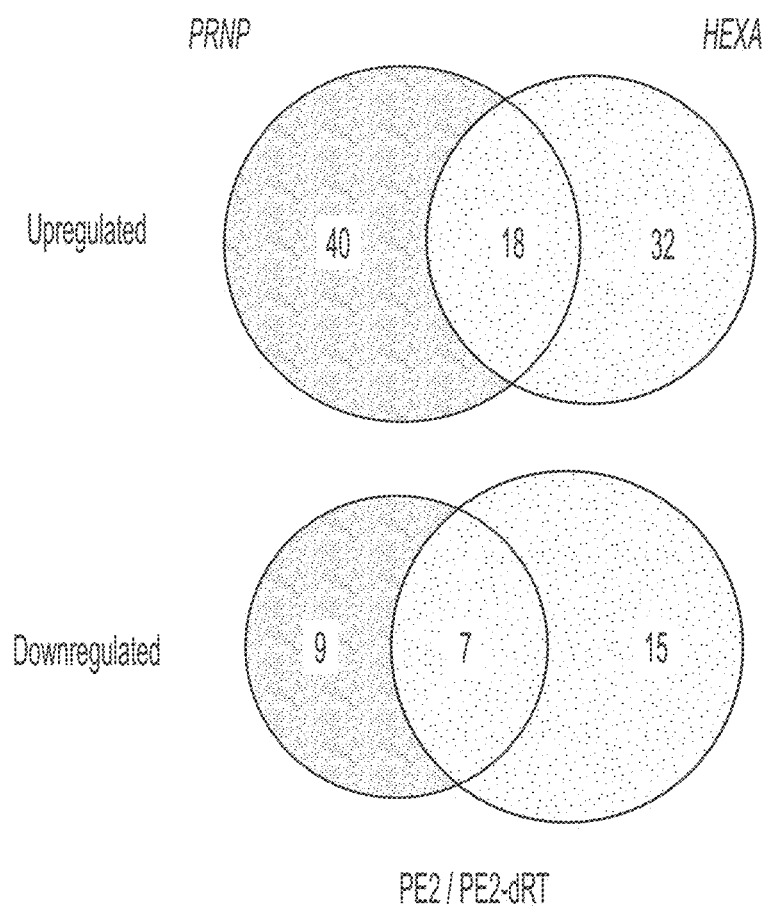
Figure 57H:
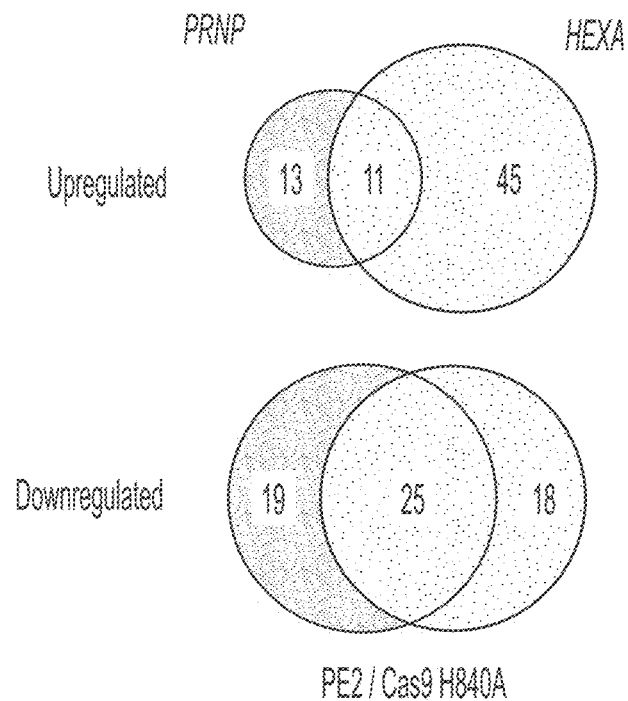
Figure 57I:
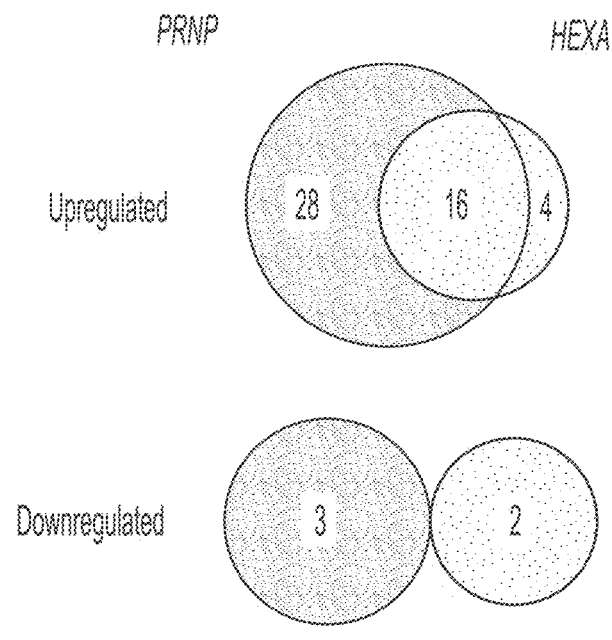

FIGS. 57A-57I show the effects of PE2, PE2-dRT, and Cas9 H840A nickase on transcriptome-wide RNA abundance. Analysis of cellular RNA, depleted for ribosomal RNA, isolated from HEK293T cells expressing PE2, PE2-dRT, or Cas9 H840A nickase and a PRNP-targeting or HEXA-targeting PEgRNA. RNAs corresponding to 14,410 genes and 14,368 genes were detected in PRNP and HEXA samples, respectively. FIGS. 57A-57F show Volcano plot displaying the −log 10 FDR-adjusted p-value vs. log 2-fold change in transcript abundance for Aeach RNA, comparing (FIG. 57A) PE2 vs. PE2-dRT with PRNP-targeting PEgRNA, (FIG. 57B) PE2 vs. Cas9 H840A with PRNP-targeting PEgRNA, (FIG. 57C) PE2-dRT vs. Cas9 H840A with PRNP-targeting PEgRNA, (FIG. 57D) PE2 vs. PE2-dRT with HEXA-targeting PEgRNA, (FIG. 57E) PE2 vs. Cas9 H840A with HEXA-targeting PEgRNA, (FIG. 57F) PE2-dRT vs. Cas9 H840A with HEXA-targeting PEgRNA. Red dots indicate genes that show ≥2-fold change in relative abundance that are statistically significant (FDR-adjusted p<0.05). FIGS. 57G-57I are Venn diagrams of upregulated and downregulated transcripts (≥2-fold change) comparing PRNP and HEXA samples for (FIG. 57G) PE2 vs PE2-dRT, (FIG. 57H) PE2 vs. Cas9 H840A, and (FIG. 57I) PE2-dRT vs. Cas9 H840A.

Figure 58A:
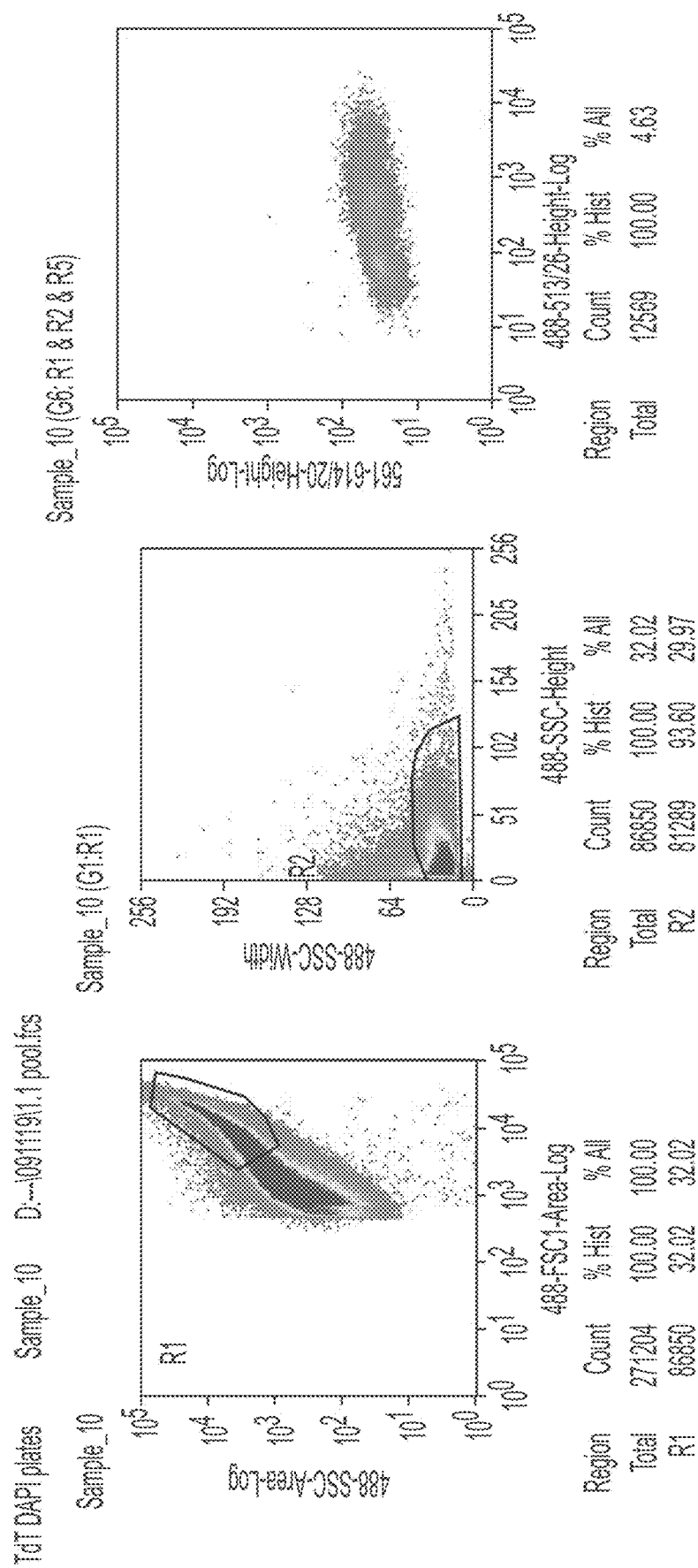

FIGS. 58A-58B show representative FACS gating for neuronal nuclei sorting. Nuclei were sequentially gated on the basis of DyeCycle Ruby signal, FSC/SSC ratio, SSC-Width/SSC-height ratio, and GFP/DyeCycle ratio.

FIGS. 59A-59G show the protocol for cloning 3'-extended PEgRNAs into mammalian U6 expression vectors by Golden Gate assembly. FIG. 59A shows the cloning overview. FIG. 59B shows 'Step 1: Digest pU6-PEgRNA-GG-Vector plasmid (component 1)'. FIG. 59C shows 'Steps 2 and 3: Order and anneal oligonucleotide parts (components 2, 3, and 4)'. FIG. 59D shows 'Step 2.b.ii.: sgRNA scaffold phosphorylation (unnecessary if oligonucleotides were purchased phosphorylated)'. FIG. 59E shows 'Step 4: PEgRNA assembly'. FIG. 59F shows 'Steps 5 and 6: Transformation of assembled plasmids'. FIG. 59G shows a diagram summarizing the PEgRNA cloning protocol.

FIGS. 60A-60B show the Python script for quantifying PEgRNA scaffold integration. A custom python script was generated to characterize and quantify PEgRNA insertions at target genomic loci. The script iteratively matches text strings of increasing length taken from a reference sequence (guide RNA scaffold sequence) to the sequencing reads within fastq files, and counts the number of sequencing reads that match the search query. Each successive text string corresponds to an additional nucleotide of the guide RNA scaffold sequence. Exact length integrations and cumulative integrations up to a specified length were calculated in this manner. At the start of the reference sequence, 5 to 6 bases of the 3' end of the new DNA strand synthesized by the reverse transcriptase are included to ensure alignment and accurate counting of short slices of the sgRNA.

Figure 61:
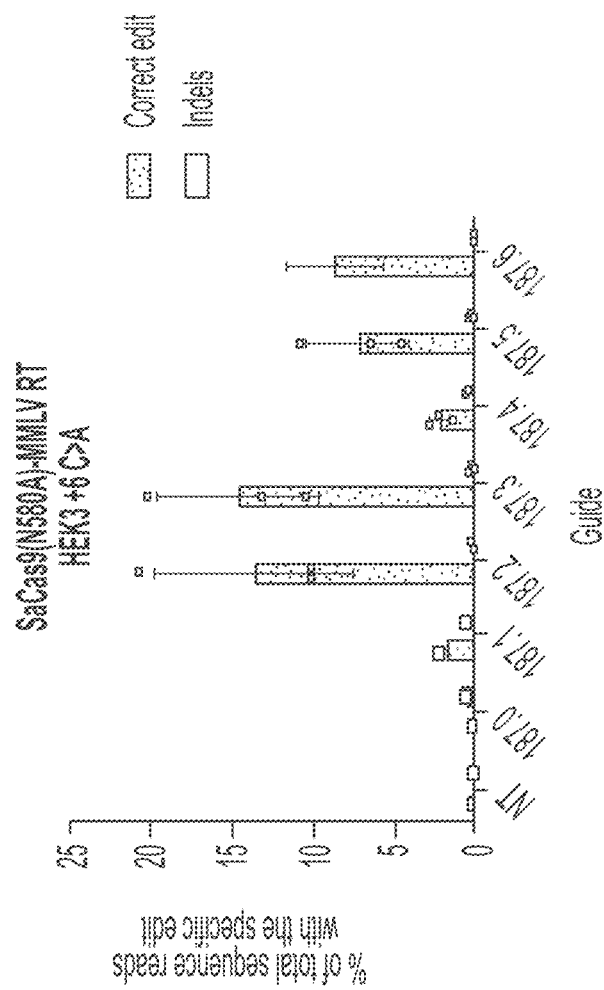

FIG. 61 is a graph showing the percent of total sequencing reads with the specified edit for SaCas9(N580A)-MMLV RT HEK3 +6 C>A. The values for the correct edits as well as indels are shown.

Figure 62A:
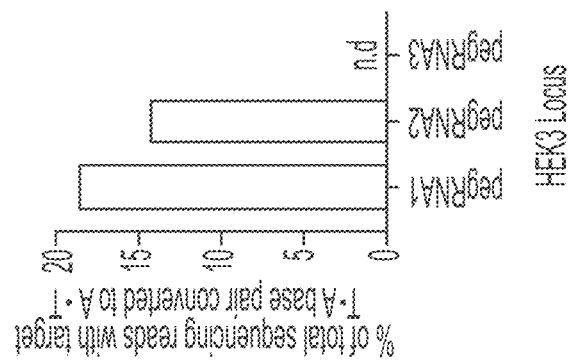
Figure 62B:
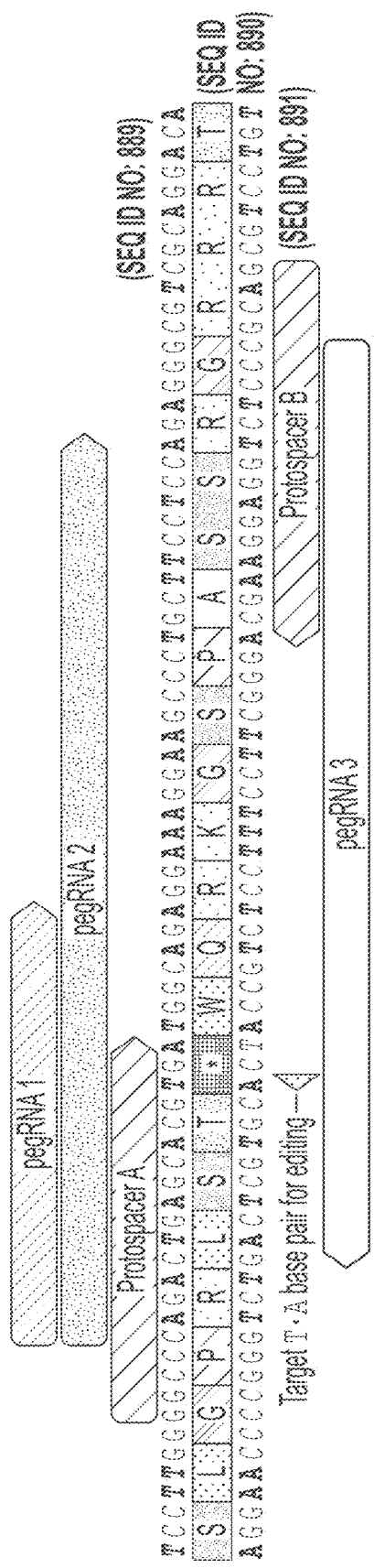

FIGS. 62A-62B show the importance of the protospacer for efficient installation of a desired edit at a precise location with prime editing. FIG. 62A is a graph showing the percent of total sequencing reads with target T.A base pairs converted to A.T for various HEK3 loci. FIG. 62B is a sequence analysis showing the same.

Figure 63:
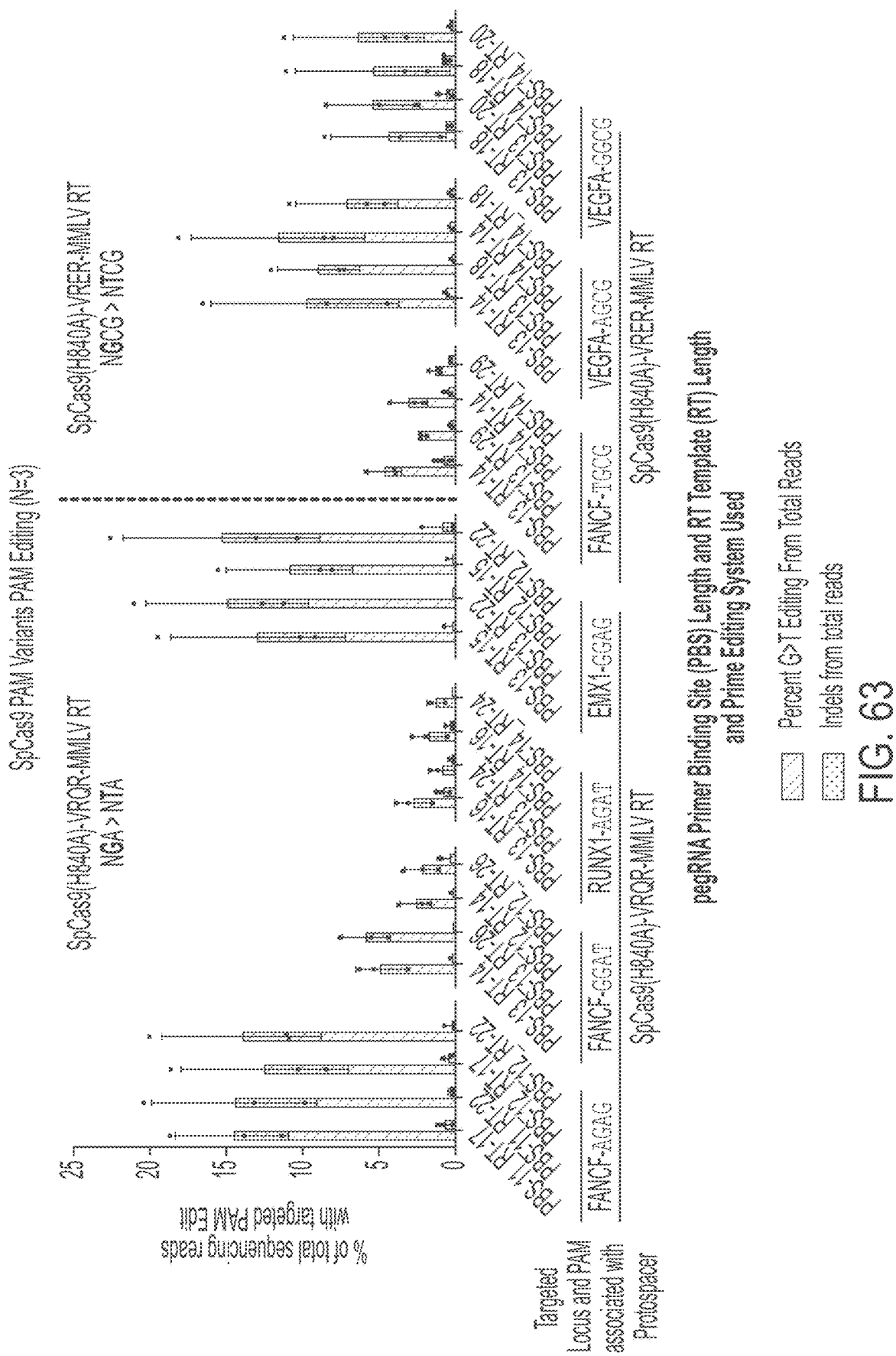

FIG. 63 is a graph showing SpCas9 PAM variants in PAM editing (N=3). The percent of total sequencing reads with the targeted PAM edit is shown for SpCas9(H840A)-VRQR-MMLV RT, where NGA >NTA, and for SpCas9(H840A)-VRER-MMLV RT, where NGCG >NTCG. The PEgRNA primer binding site (PBS) length, RT template (RT) length, and PE system used are listed.

Figure 64A:
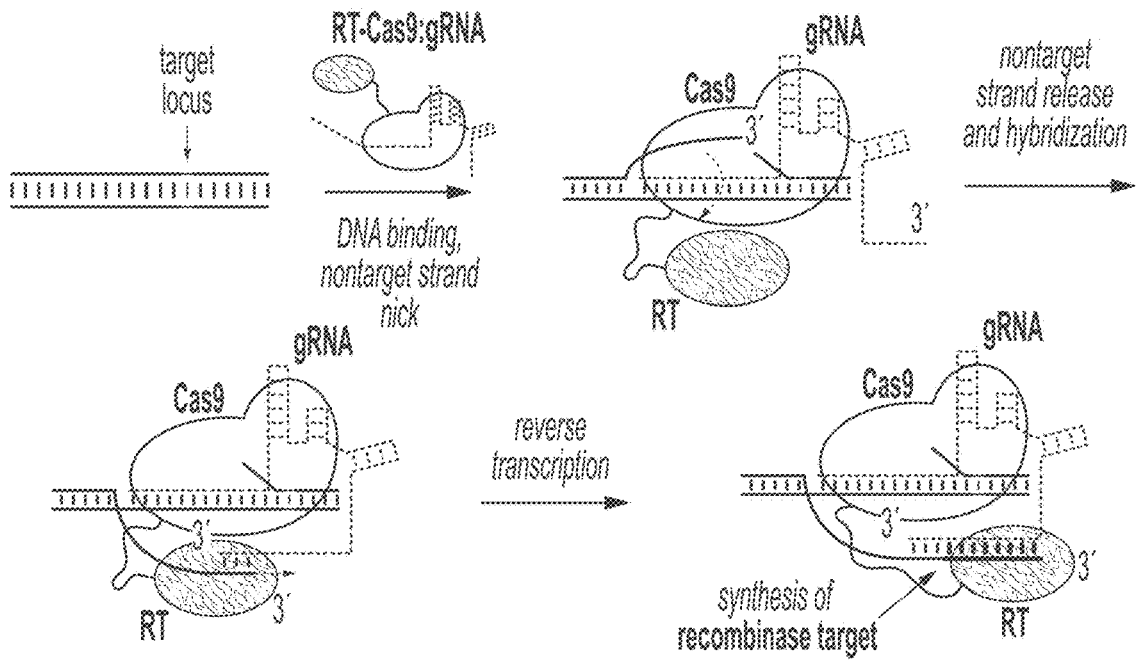
Figure 64B:
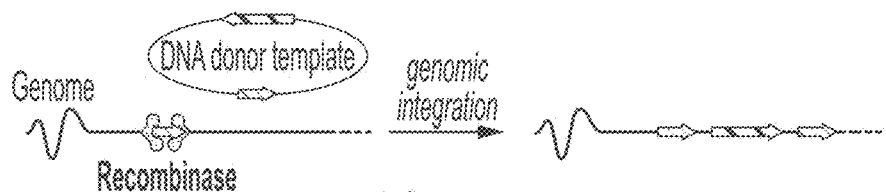
Figure 64C:
Figure 64D:
Figure 64E:
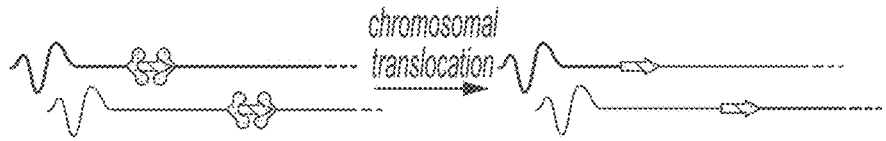
Figure 64F:
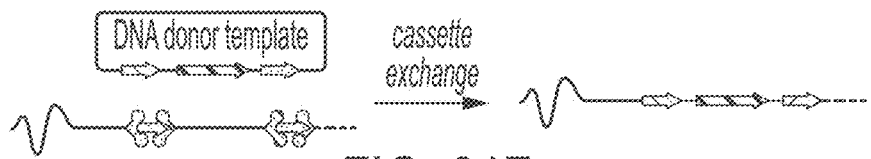

FIGS. 64A-64F depict a schematic showing the introduction of various site-specific recombinase (SSR) targets into the genome using PE. FIG. 64A provides a general schematic of the insertion of a recombinase target sequence by a prime editor. FIG. 64B shows how a single SSR target inserted by PE can be used as a site for genomic integration of a DNA donor template. FIG. 64C shows how a tandem insertion of SSR target sites can be used to delete a portion of the genome. FIG. 64D shows how a tandem insertion of SSR target sites can be used to invert a portion of the genome. FIG. 64E shows how the insertion of two SSR target sites at two distal chromosomal regions can result in chromosomal translocation. FIG. 64F shows how the insertion of two different SSR target sites in the genome can be used to exchange a cassette from a DNA donor template. See Example 17 for further details.

Figure 65:
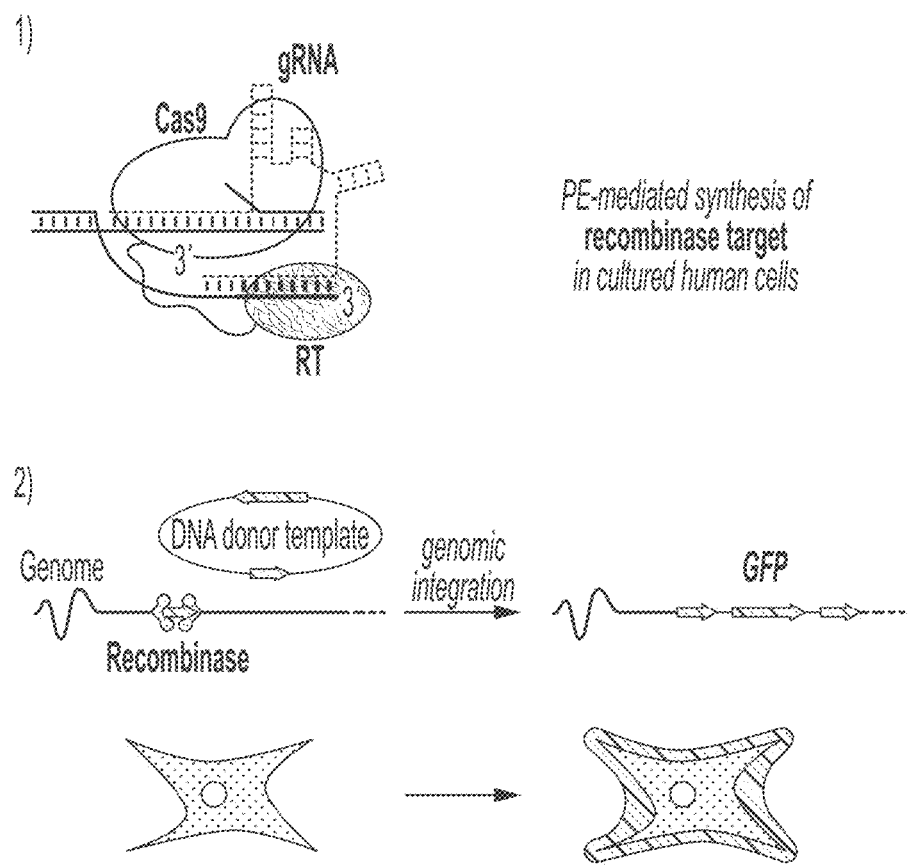

FIG. 65 shows in 1) the PE-mediated synthesis of a SSR target site in a human cell genome and 2) the use of that SSR target site to integrate a DNA donor template comprising a GFP expression marker. Once successfully integrated, the GFP causes the cell to fluoresce. See Example 17 for further details.

Figure 66:
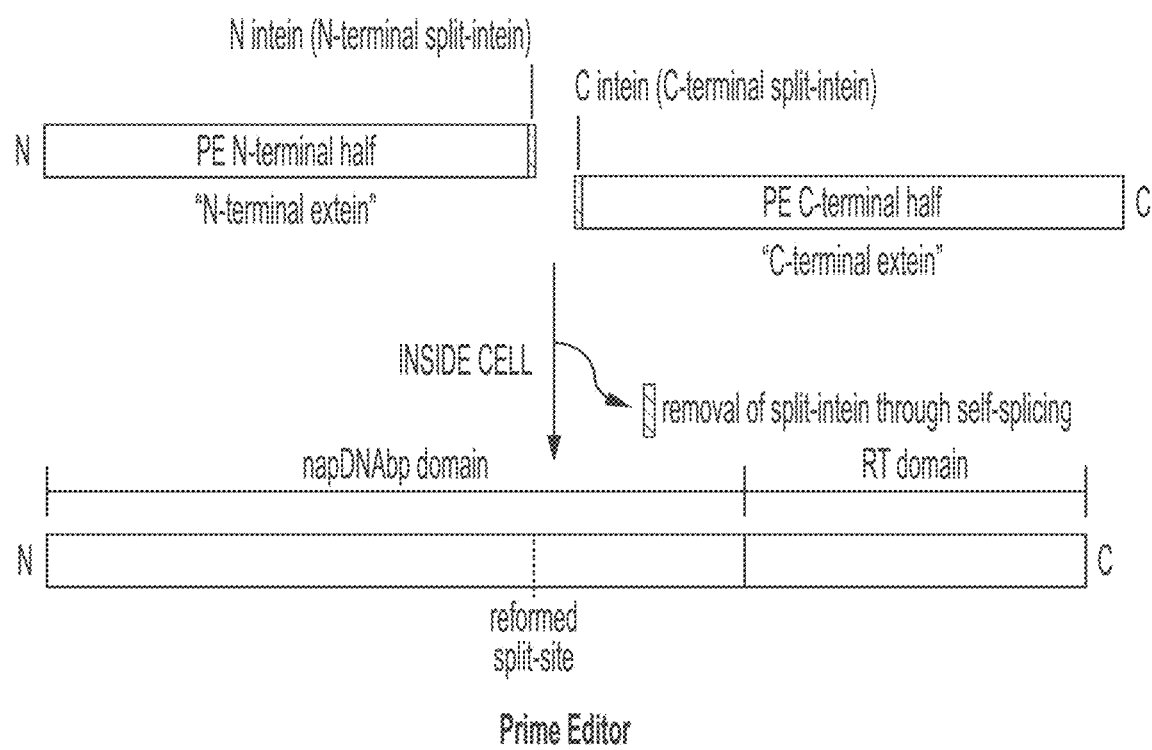

FIG. 66 depicts one embodiment of a prime editor being provided as two PE half proteins which regenerate as whole prime editor through the self-splicing action of the split-intein halves located at the end or beginning of each of the prime editor half proteins.

Figure 67A:
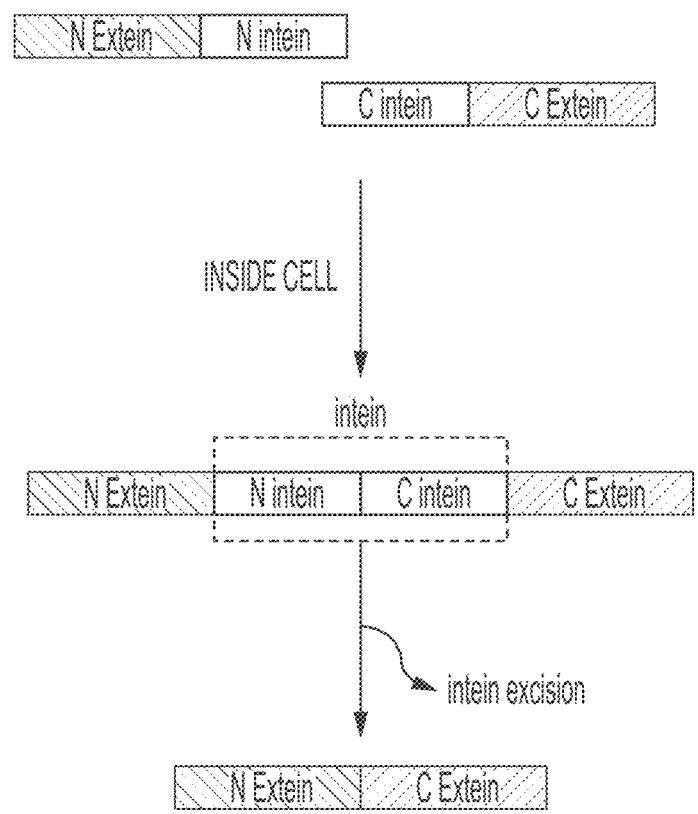
Figure 67B:
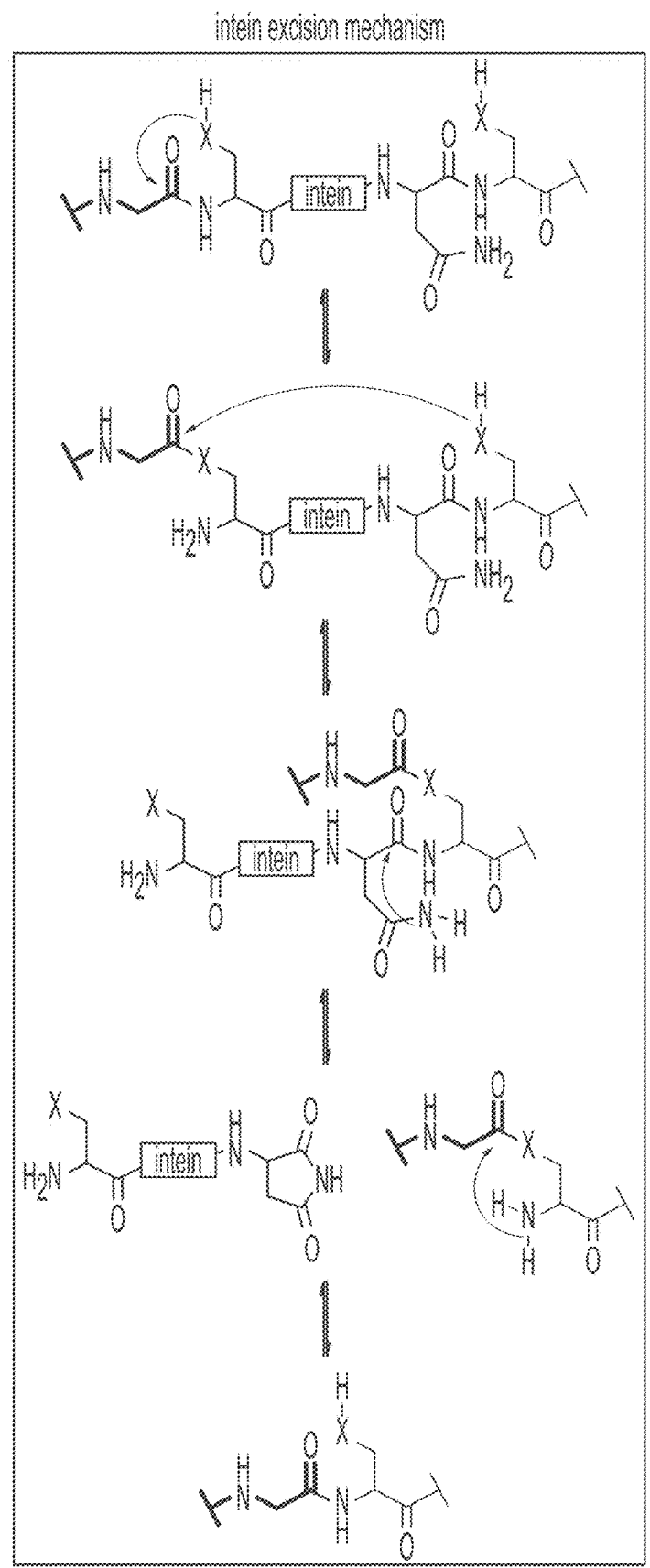

FIGS. 67A-67B depict the mechanism of intein removal from a polypeptide sequence and the reformation of a peptide bond between the N-terminal and the C-terminal extein sequences. FIG. 67A depicts the general mechanism of two half proteins each containing half of an intein sequence, which when in contact within a cell result in a fully-functional intein which then undergoes self-spicing and excision. The process of excision results in the formation of a peptide bond between the N-terminal protein half (or the "N extein") and the C-terminal protein half (or the "C extein") to form a whole, single polypeptide comprising the N extein and the C extein portions. In various embodiments, the N extein may correspond to the N-terminal half of a split prime editor fusion protein and the C extein may correspond to the C-terminal half of a split prime editor. FIG. 67B shows a chemical mechanism of intein excision and the reformation of a peptide bond that joins the N extein half (the red-colored half) and the C extein half (the blue-colored half). Excision of the split inteins (i.e., the N intein and the C intein in the split intein configuration) may also be referred to as "trans splicing" as it involves the splicing action of two separate components provided in trans.

Figure 68A:
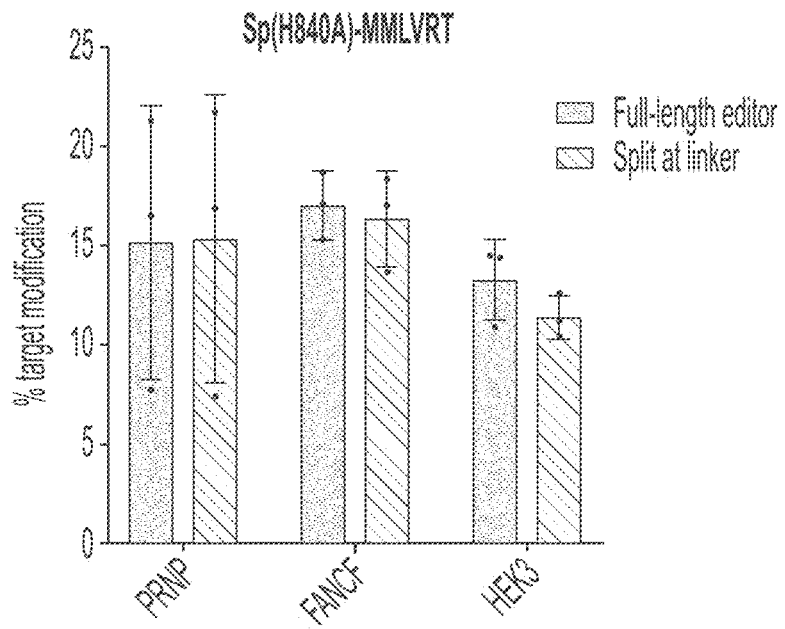

FIG. 68A demonstrates that delivery of both split intein halves of SpPE (SEQ ID NOs: 3875, 3876) at the linker maintains activity at three test loci when co-transfected into HEK293T cells.

Figure 68B:
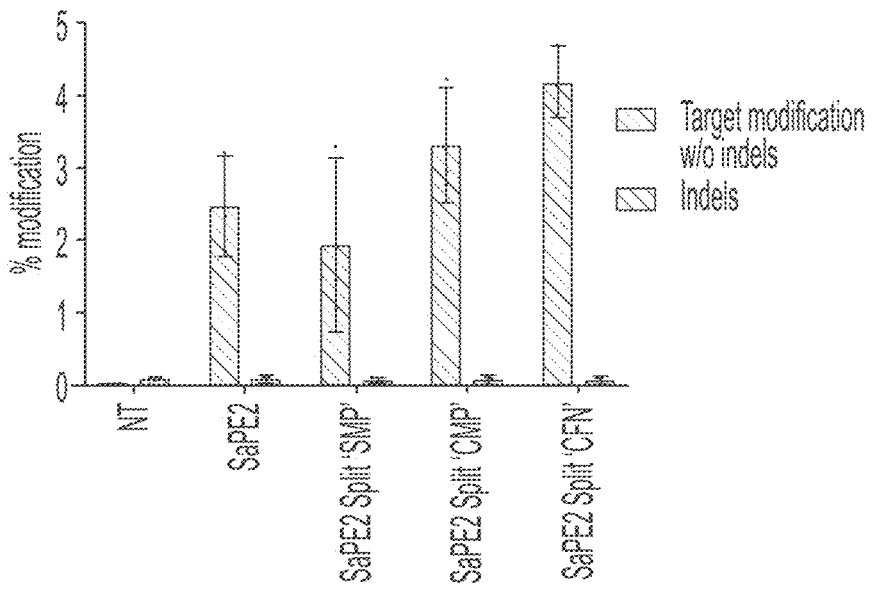

FIG. 68B demonstrates that delivery of both split intein halves of SaPE2 (e.g., SEQ ID NO: 443 and SEQ ID NO: 450) recapitulate activity of full length SaPE2 (SEQ ID NO: 134) when co-transfected into HEK293T cells. Residues indicated in quotes are the sequence of amino acids 741-743 in SaCas9 (first residues of the C-terminal extein) which are important for the intein trans splicing reaction. 'SMP' are the native residues, which we also mutated to the 'CFN' consensus splicing sequence. The consensus sequence is shown to yield the highest reconstitution as measured by prime editing percentage.

Figure 68C:
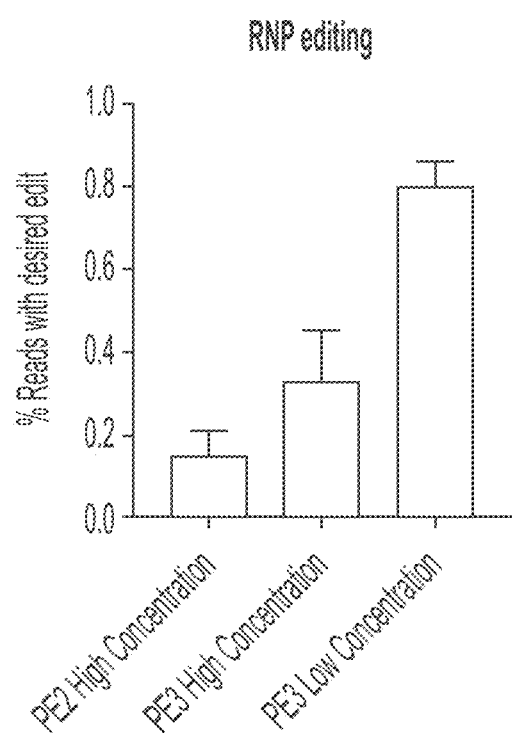

FIG. 68C provides data showing that various disclosed PE ribonucleoprotein complexes (PE2 at high concentration, PE3 at high concentration and PE3 at low concentration) can be delivered in this manner.

Figure 69:
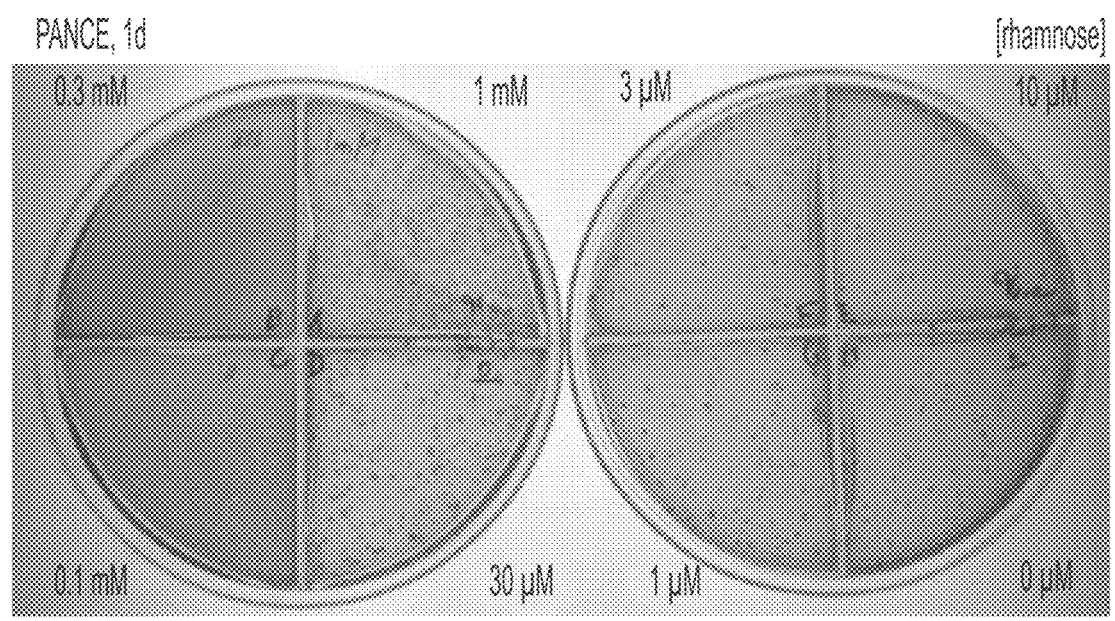

FIG. 69 shows a bacteriophage plaque assay to determine PE effectiveness in PANCE. Plaques (dark circles) indicate phage able to successfully infect *E. coli*. Increasing concentration of L-rhamnose results in increased expression of PE and an increase in plaque formation. Sequencing of plaques revealed the presence of the PE-installed genomic edit.

FIGS. 70A-70I provide an example of an edited target sequence as an illustration of a step-by-step instruction for designing PEgRNAs and nicking-sgRNAs for prime editing. FIG. 70A: Step 1. Define the target sequence and the edit. Retrieve the sequence of the target DNA region (~200 bp) centered around the location of the desired edit (point mutation, insertion, deletion, or combination thereof). FIG. 70B: Step 2. Locate target PAMs. Identify PAMs in proximity to the edit location. Be sure to look for PAMs on both strands. While PAMs close to the edit position are preferred, it is possible to install edits using protospacers and PAMs that place the nick ≥30 nt from the edit position. FIG. 70C: Step 3. Locate the nick sites. For each PAM being considered, identify the corresponding nick site. For Sp Cas9 H840A nickase, cleavage occurs in the PAM-containing strand between the $3^{rd}$ and $4^{th}$ bases 5' to the NGG PAM. All edited nucleotides must exist 3' of the nick site, so appropriate PAMs must place the nick 5' to the target edit on the PAM-containing strand. In the example shown below, there are two possible PAMs. For simplicity, the remaining steps will demonstrate the design of a PEgRNA using PAM 1 only. FIG. 70D: Step 4. Design the spacer sequence. The protospacer of Sp Cas9 corresponds to the 20 nucleotides 5' to the NGG PAM on the PAM-containing strand. Efficient Pol III transcription initiation requires a G to be the first transcribed nucleotide. If the first nucleotide of the protospacer is a G, the spacer sequence for the PEgRNA is simply the protospacer sequence. If the first nucleotide of the protospacer is not a G, the spacer sequence of the PEgRNA is G followed by the protospacer sequence. FIG. 70E: Step 5. Design a primer binding site (PBS). Using the starting allele sequence, identify the DNA primer on the PAM-containing strand. The 3' end of the DNA primer is the nucleotide just upstream of the nick site (i.e. the $4^{th}$ base 5' to the NGG PAM for Sp Cas9). As a general design principle for use with PE2 and PE3, a PEgRNA primer binding site (PBS) containing 12 to 13 nucleotides of complementarity to the DNA primer can be used for sequences that contain ~40-60% GC content. For sequences with low GC content, longer (14- to 15-nt) PBSs should be tested. For sequences with higher GC content, shorter (8- to 11-nt) PBSs should be tested. Optimal PBS sequences should be determined empirically, regardless of GC content. To design a length-p PBS sequence, take the reverse complement of the first p nucleotides 5' of the nick site in the PAM-containing strand using the starting allele sequence. FIG. 70F: Step 6. Design an RT template. The RT template encodes the designed edit and homology to the sequence adjacent to the edit. Optimal RT template lengths vary based on the target site. For short-range edits (positions +1 to +6), it is recommended to test a short (9 to 12 nt), a medium (13 to 16 nt), and a long (17 to 20 nt) RT template. For long-range edits (positions +7 and beyond), it is recommended to use RT templates that extend at least 5 nt (preferably 10 or more nt) past the position of the edit to allow for sufficient 3' DNA flap homology. For long-range edits, several RT templates should be screened to identify functional designs. For larger insertions and deletions (>5 nt), incorporation of greater 3' homology (~20 nt or more) into the RT template is recommended. Editing efficiency is typically impaired when the RT template encodes the synthesis of a G as the last nucleotide in the reverse transcribed DNA product (corresponding to a C in the RT template of the PEgRNA). As many RT templates support efficient prime editing, avoidance of G as the final synthesized nucleotide is recommended when designing RT templates. To design a length-r RT template sequence, use the desired allele sequence and take the reverse complement of the first r nucleotides 3' of the nick site in the strand that originally contained the PAM. Note that compared to SNP edits, insertion or deletion edits using RT templates of the same length will not contain identical homology. FIG. 70G: Step 7. Assemble the full PEgRNA sequence. Concatenate the PEgRNA components in the following order (5' to 3'): spacer, scaffold, RT template and PBS. FIG. 70H: Step 8. Designing nicking-sgRNAs for PE3. Identify PAMs on the non-edited strand upstream and downstream of the edit. Optimal nicking positions are highly locus-dependent and should be determined empirically. In general, nicks placed 40 to 90 nucleotides 5' to the position across from the PEgRNA-induced nick lead to higher editing yields and fewer indels. A nicking sgRNA has a spacer sequence that matches the 20-nt protospacer in the starting allele, with the addition of a 5'-G if the protospacer does not begin with a G. FIG. 70I: Step 9. Designing PE3b nicking-sgRNAs. If a PAM exists in the complementary strand and its corresponding protospacer overlaps with the sequence targeted for editing, this edit could be a candidate for the PE3b system. In the PE3b system, the spacer sequence of the nicking-sgRNA matches the sequence of the desired edited allele, but not the starting allele. The PE3b system operates efficiently when the edited nucleotide(s) falls within the seed region (~10 nt adjacent to the PAM) of the nicking-sgRNA protospacer. This prevents nicking of the complementary strand until after installation of the edited strand, preventing competition between the PEgRNA and the sgRNA for binding the target DNA. PE3b also avoids the generation of simultaneous nicks on both strands, thus reducing indel formation significantly while maintaining high editing efficiency. PE3b sgRNAs should have a spacer sequence that matches the 20-nt protospacer in the desired allele, with the addition of a 5' G if needed.

Figure 71A:
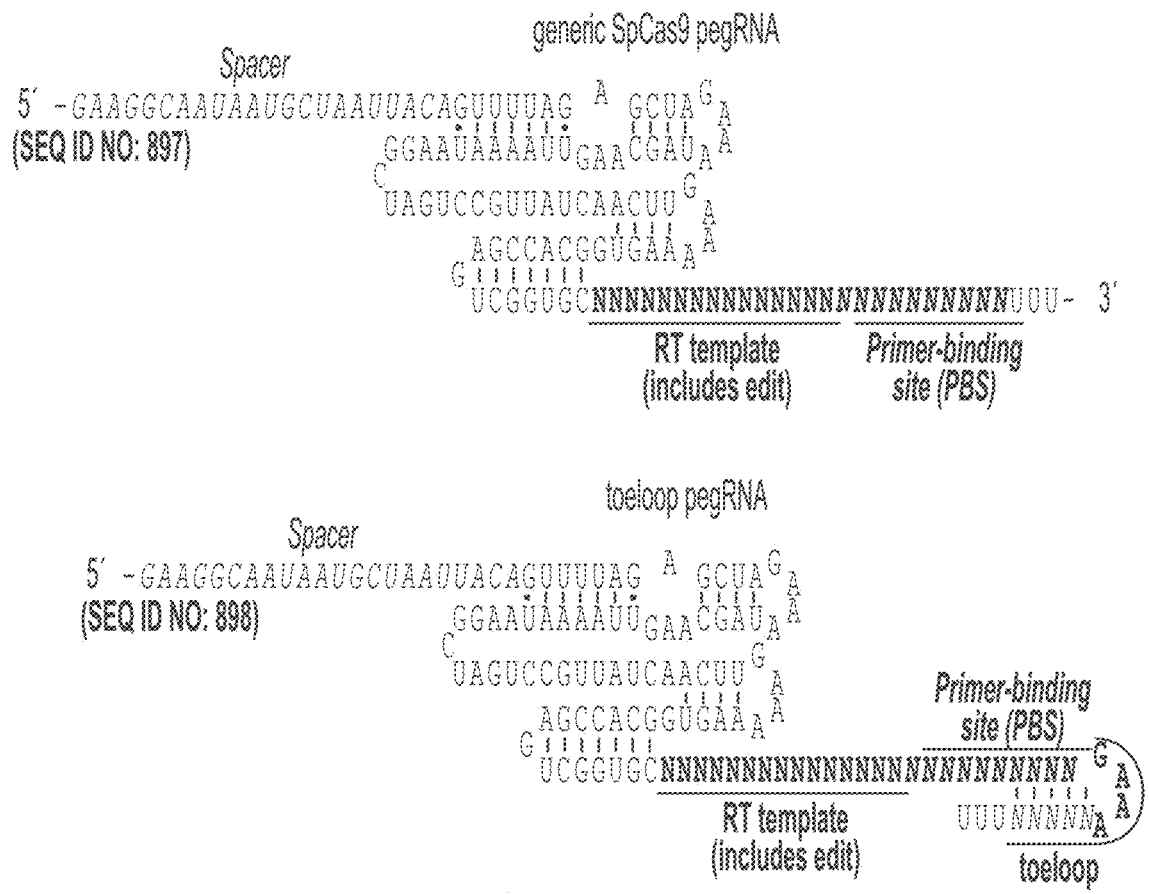

FIG. 71A shows the nucleotide sequence of a SpCas9 PEgRNA molecule (top) which terminates at the 3' end in a "UUU" and does not contain a toeloop element. The lower portion of the figure depicts the same SpCas9 PEgRNA molecule but is further modified to contain a toeloop element having the sequence 5'-"GAAANNNNN"-3' inserted immediately before the "UUU" 3' end. The "N" can be any nucleobase.

Figure 71B:
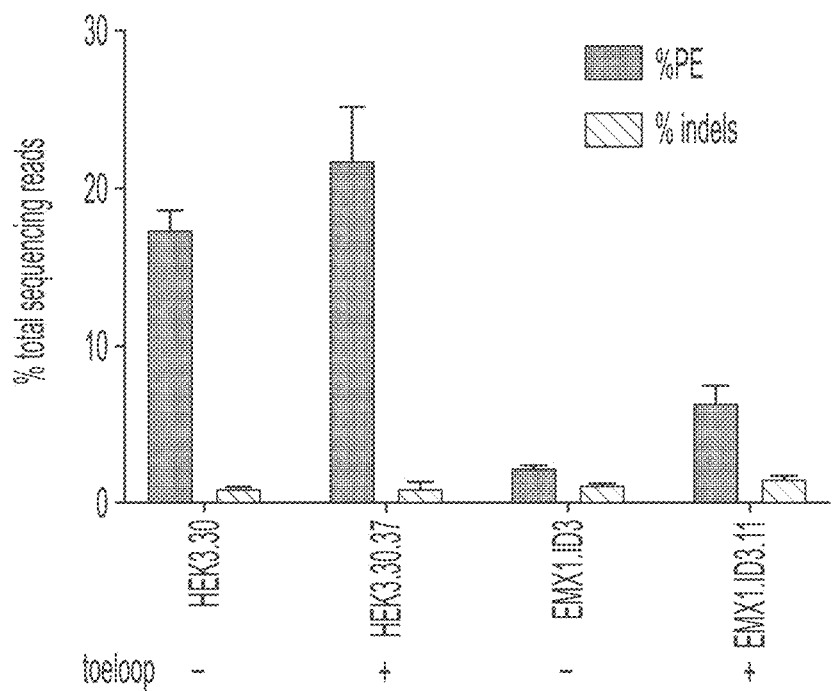

FIG. 71B shows the results of Example 18, which demonstrates that the efficiency of prime editing in HEK cells or EMX cells is increased using PEgRNA containing toeloop elements, whereas the percent of indel formation is largely unchanged.

Figure 72A:
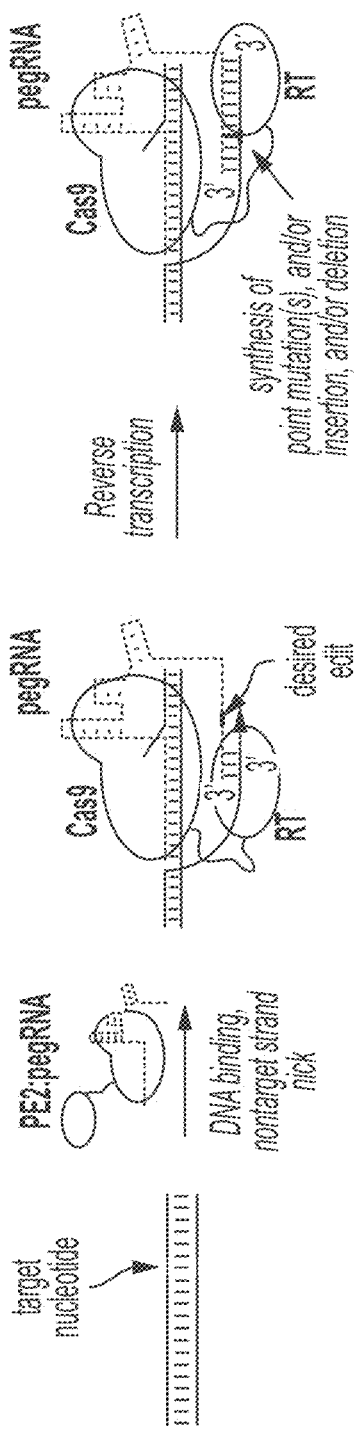
Figure 72B:
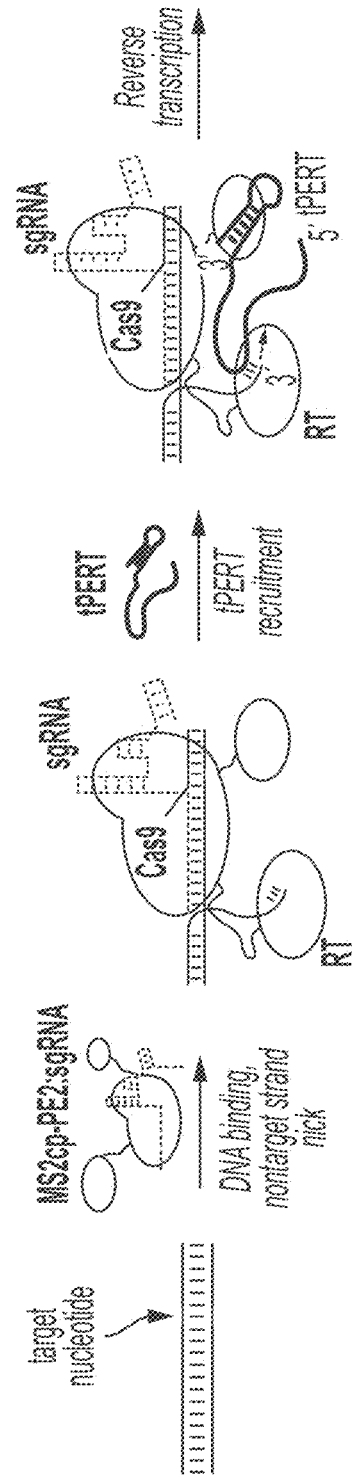
Figure 72C:
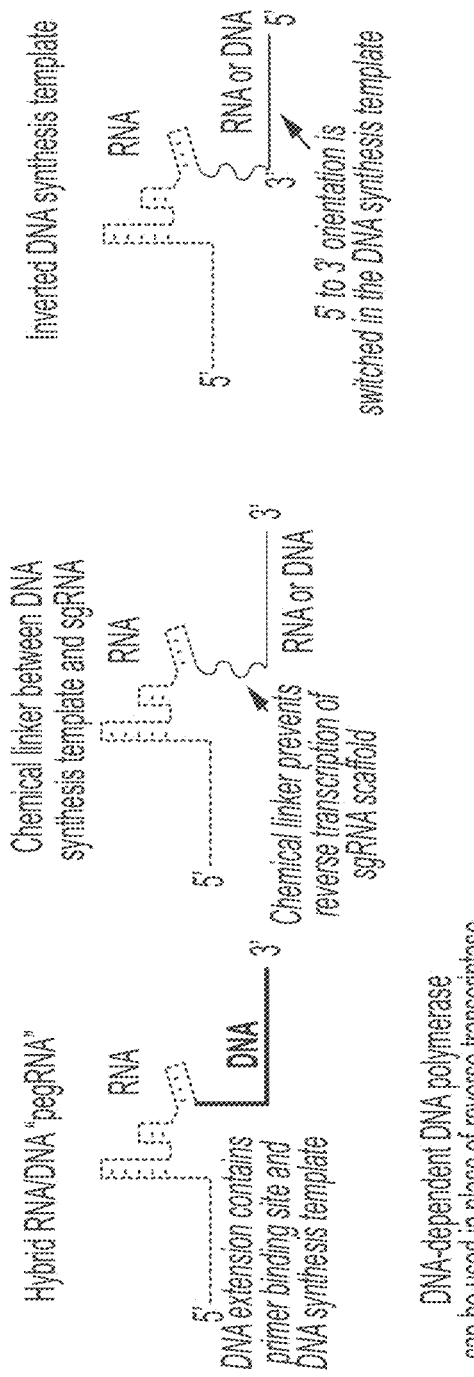

FIGS. 72A-72C depict alternative PEgRNA configurations that can be used in prime editing. FIG. 72A depicts the PE2:PEgRNA embodiment of prime editing. This embodiment involves a PE2 (a fusion protein comprising a Cas9 and a reverse transcriptase) complexed with a PEgRNA (as also described in FIGS. 1A-1I and/or FIGS. 3A-3E). In this embodiment, the template for reverse transcription is incorporated into a 3' extension arm on the sgRNA to make the PEgRNA, and the DNA polymerase enzyme is a reverse transcriptase (RT) fused directly to Cas9. FIG. 72B depicts the MS2cp-PE2:sgRNA+tPERT embodiment. This embodiment comprises a PE2 fusion (Cas9+a reverse transcriptase) that is further fused to the MS2 bacteriophage coat protein (MS2cp) to form the MS2cp-PE2 fusion protein. To achieve prime editing, the MS2cp-PE2 fusion protein is complexed with an sgRNA that targets the complex to a specific target site in the DNA. The embodiment then involves the introduction of a trans prime editing RNA template ("tPERT"), which operates in place of a PEgRNA by providing a primer binding site (PBS) and an DNA synthesis template on separate molecule, i.e., the tPERT, which is also equipped with a MS2 aptamer (stem loop). The MS2cp protein recruits the tPERT by binding to the MS2 aptamer of the molecule. FIG. 72C depicts alternative designs for PEgRNAs that can be achieved through known methods for chemical synthesis of nucleic acid molecules. For example, chemical synthesis can be used to synthesize a hybrid RNA/DNA PEgRNA molecule for use in prime editing, wherein the extension arm of the hybrid PEgRNA is DNA instead of RNA. In such an embodiment, a DNA-dependent DNA polymerase can be used in place of a reverse transcriptase to synthesize the 3' DNA flap comprising the desired genetic change that is formed by prime editing. In another embodiment, the extension arm can be synthesized to include a chemical linker that prevents the DNA polymerase (e.g., a reverse transcriptase) from using the sgRNA scaffold or backbone as a template. In still another embodiment, the extension arm may comprise a DNA synthesis template that has the reverse orientation relative to the overall orientation of the PEgRNA molecule. For example, and as shown for a PEgRNA in the 5'-to-3' orientation and with an extension attached to the 3' end of the sgRNA scaffold, the DNA synthesis template is orientated in the opposite direction, i.e., the 3'-to-5' direction. This embodiment may be advantageous for PEgRNA embodiments with extension arms positioned at the 3' end of a gRNA. By reverse the orientation of the extension arm, the DNA synthesis by the polymerase (e.g., reverse transcriptase) will terminate once it reaches the newly orientated 5' of the extension arm and will thus, not risk using the gRNA core as a template.

Figure 73:
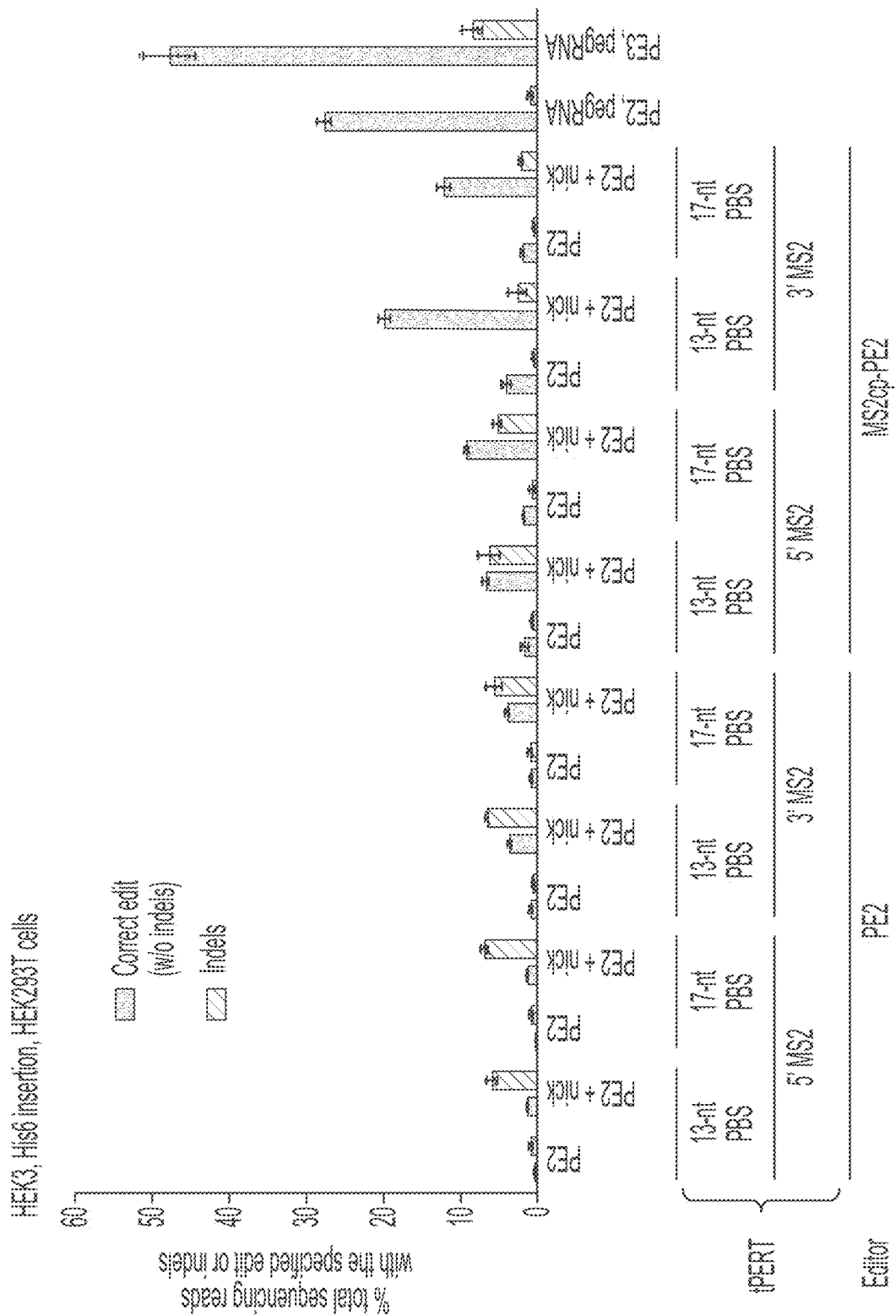

FIG. 73 demonstrates prime editing with tPERTs and the MS2 recruitment system (aka MS2 tagging technique). An sgRNA targeting the prime editor protein (PE2) to the target locus is expressed in combination with a tPERT containing a primer binding site (a13-nt or 17-nt PBS), an RT template encoding a His6 tag insertion and a homology arm, and an MS2 aptamer (located at the 5' or 3' end of the tPERT molecule). Either prime editor protein (PE2) or a fusion of the MS2cp to the N-terminus of PE2 was used. Editing was carried out with or without a complementary-strand nicking sgRNA, as in the previously developed PE3 system (designated in the x-axis as labels "PE2+nick" or "PET", respectively). This is also referred to and defined herein as "second-strand nicking."

Figure 74:
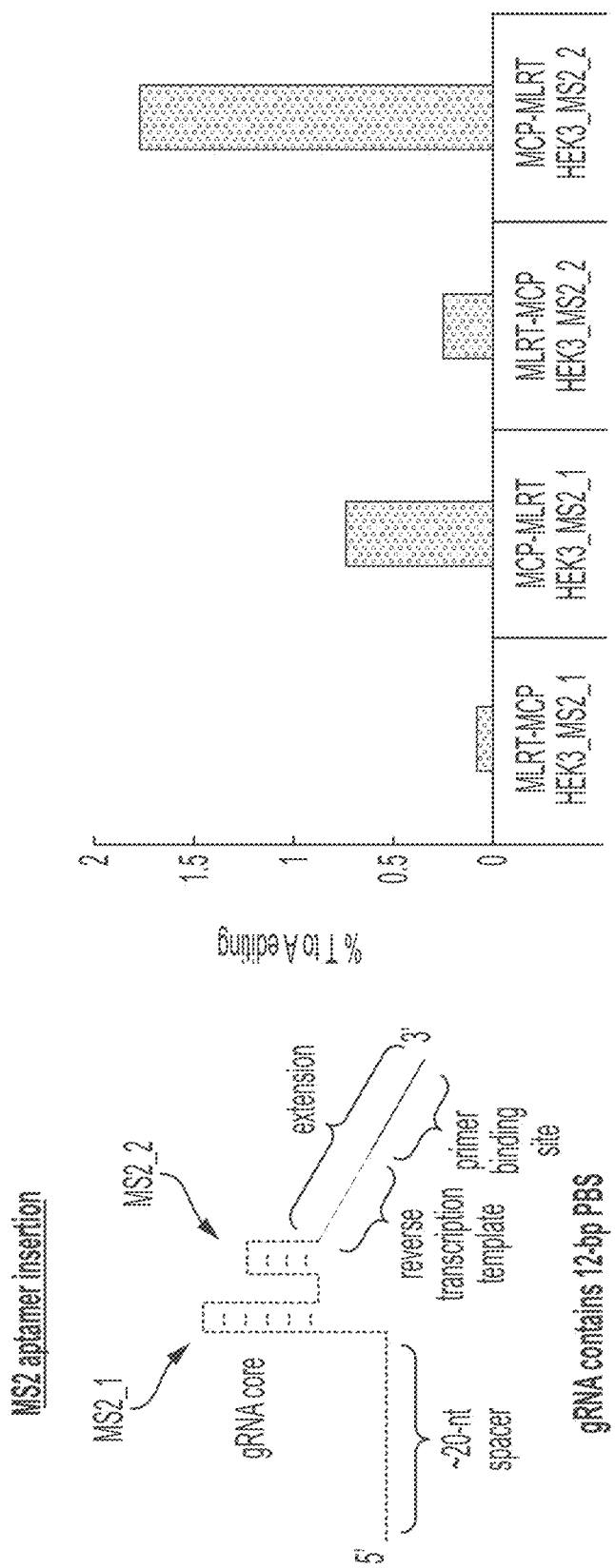

FIG. 74 demonstrates that the MS2 aptamer expression of the reverse transcriptase in trans and its recruitment with the MS2 aptamer system. The PEgRNAPEgRNA contains the MS2 RNA aptamer inserted into either one of two sgRNA scaffold hairpins. The wild-type M-MLV reverse transcriptase is expressed as an N-terminal or C-terminal fusion to the MS2 coat protein (MCP). Editing is at the HEK3 site in HEK293T cells.

Figure 75:
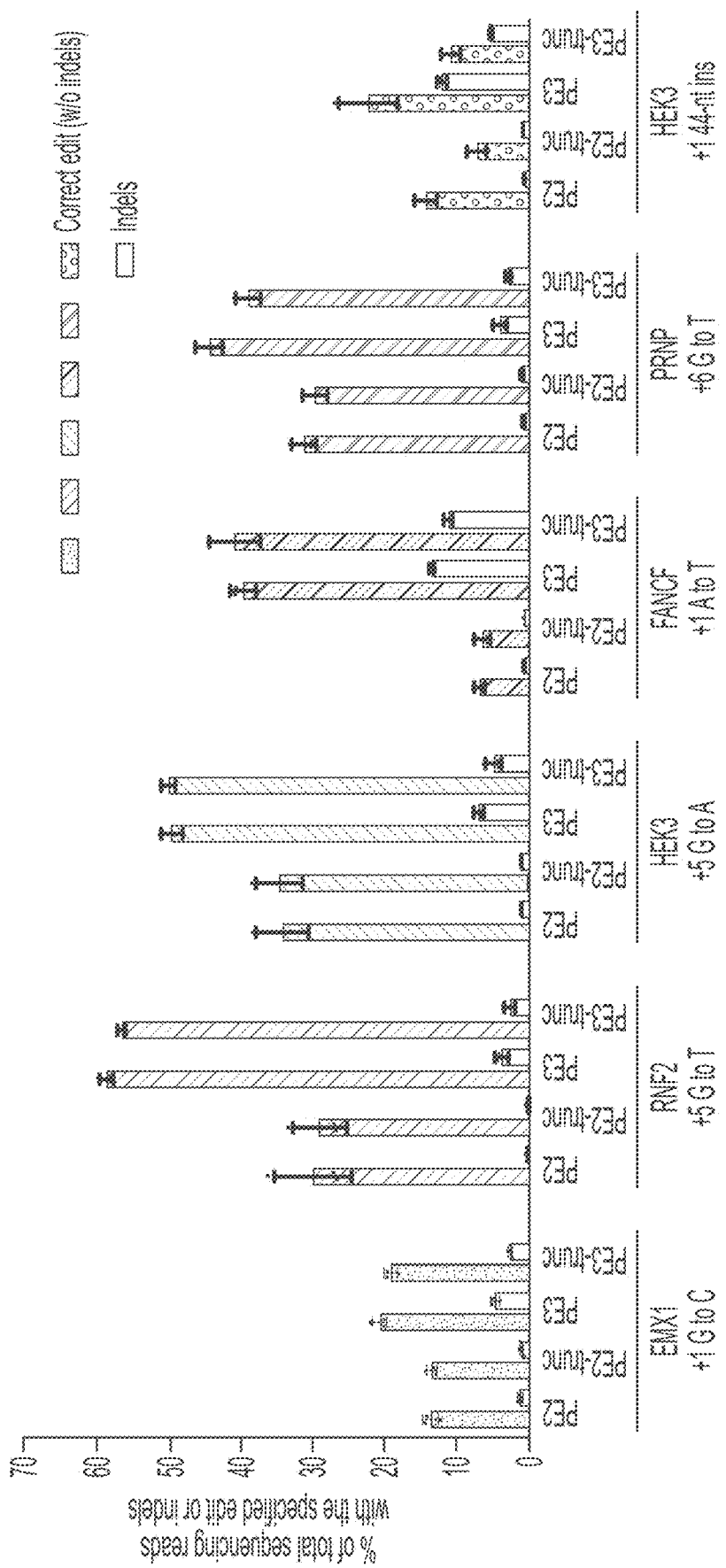

FIG. 75 provides a bar graph comparing the efficiency (i.e., "% of total sequencing reads with the specified edit or indels") of PE2, PE2-trunc, PE3, and PE3-trunc over different target sites in various cell lines. The data shows that the prime editors comprising the truncated RT variants were about as efficient as the prime editors comprising the non-truncated RT proteins.

Figure 76:
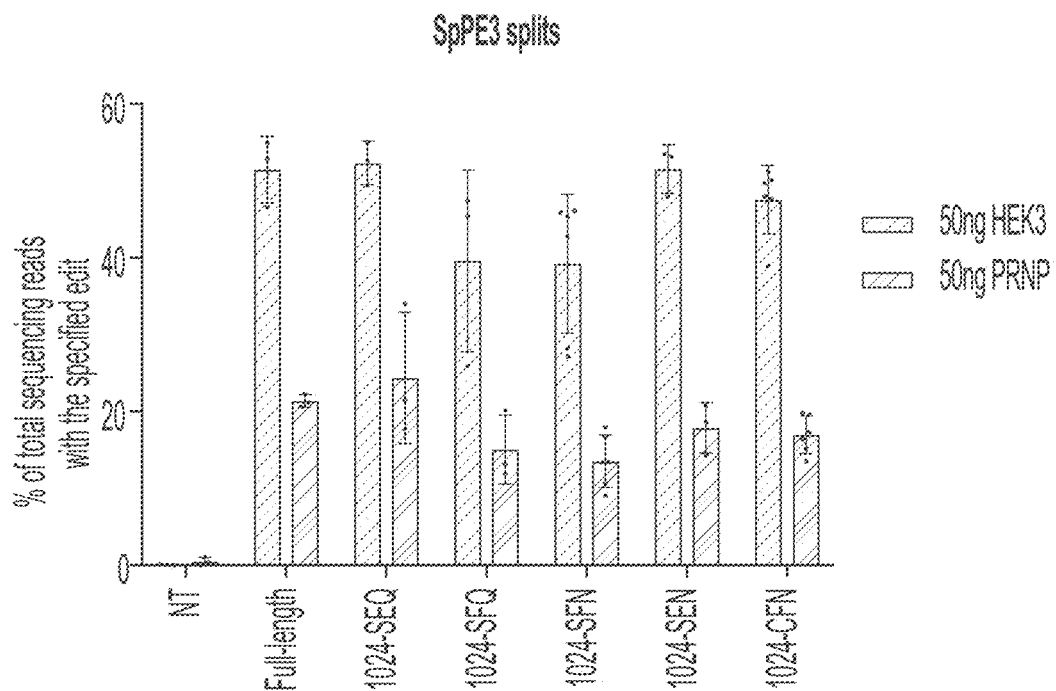

FIG. 76 demonstrates the editing efficiency of intein-split prime editors fo Example 20. HEK239T cells were transfected with plasmids encoding full-length PE2 or intein-split PE2, PEgRNA and nicking guide RNA. Consensus sequence (most amino-terminal residues of C terminal extein) are indicated. Percent editing at two sites in shown: HEK3+1 CTT insertion and PRNP +6 G to T. Replicate n=3 independent transfections. See Example 20.

Figure 77:
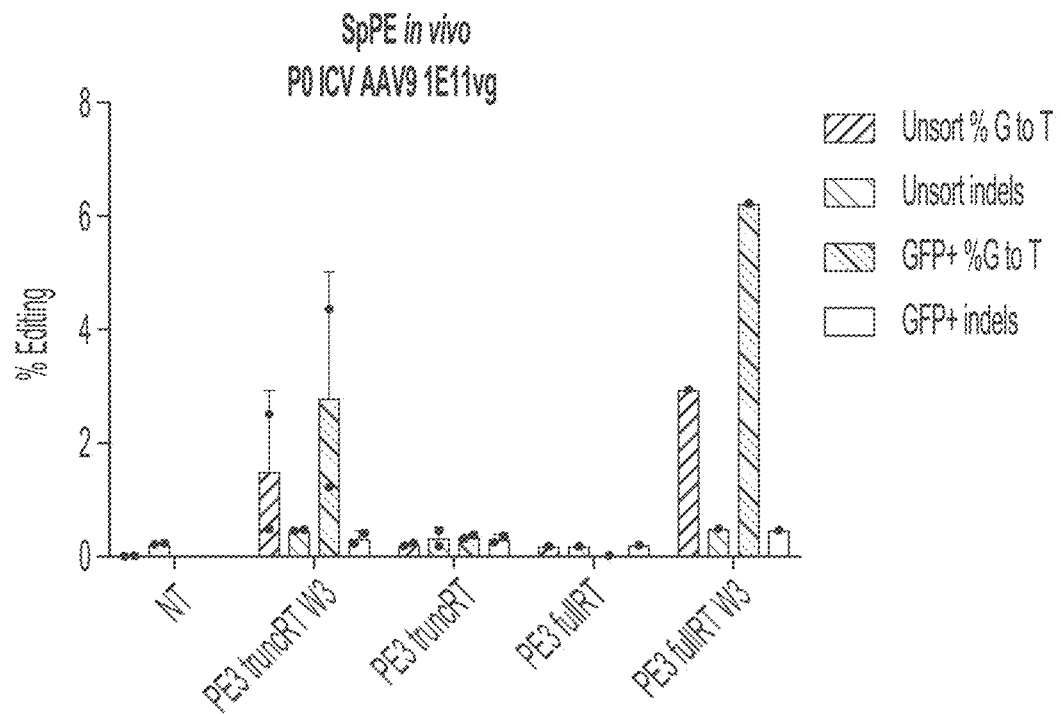

FIG. 77 demonstrates the editing efficiency of intein-split prime editors fo Example 20. Editing assessed by targeted deep sequencing in bulk cortex and GFP+ subpopulation upon delivery of 5E10vg per SpPE3 half and a small amount 1E10 of nuclear-localized GFP:KASH to P0 mice by ICV injection. Editors and GFP were packaged in AAV9 with EFS promoter. Mice were harvested three weeks post injection and GFP+ nuclei were isolated by flow cytometry. Individual data points are shown, with 1-2 mice per condition analyzed. See Example 20.

Figure 78:
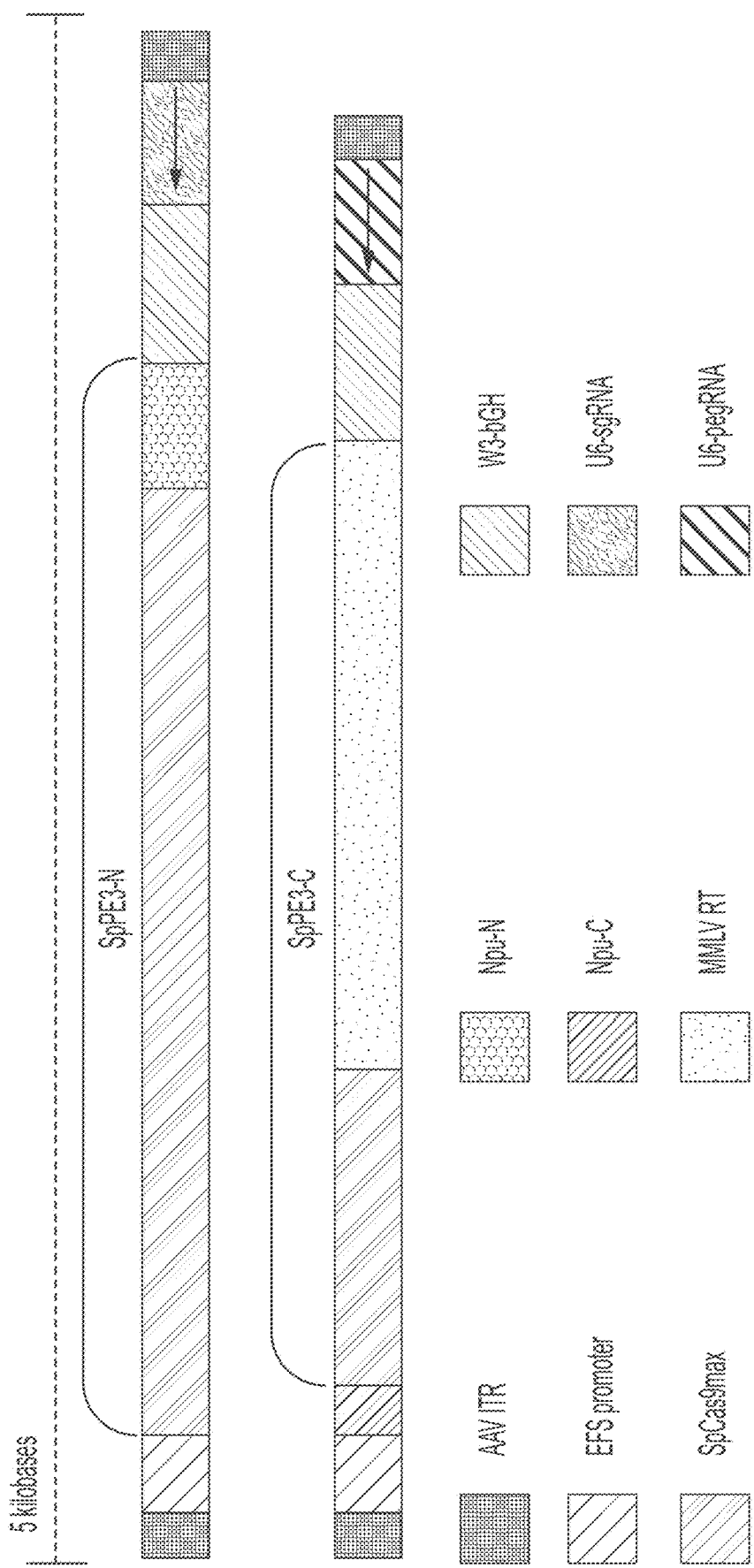

FIG. 78 demonstrates the editing efficiency of intein-split prime editors of Example 20. Specifically, the figures depicts the AAV split-SpPE3 constructs using in Example 20. Co-transduction by AAV particles separately expressing SpPE3-N and SpPE3-C recapitulates PE3 activity. Note N-terminal genome contains a U6-sgRNA cassette expressing the nicking sgRNA, and the C-terminal genome contains a U6-PEgRNA cassette expressing the PEgRNA. See Example 20.

Figure 79:
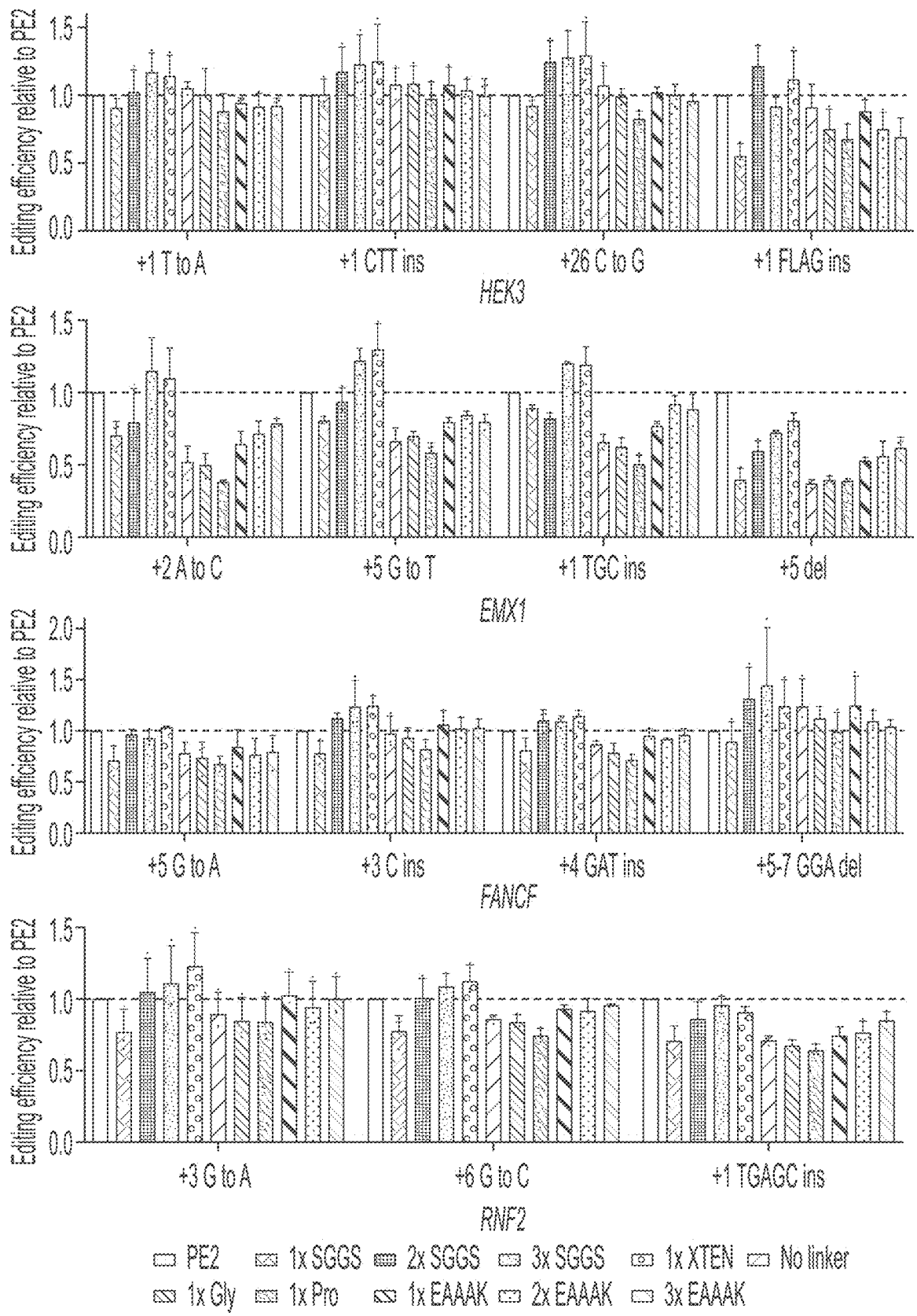

FIG. 79 shows the editing efficiency of certain optimized linkers as discussed in Example 21. In particular, the data shows the editing efficiency of the PE2 construct with the current linker (noted as PE2—white box) compared to various versions with the linker replaced with a sequence as indicated at the HEK3, EMX1, FANCF, RNF2 loci for representative PEgRNAs for transition, transversion, insertion, and deletion edits. The replacement linkers are referred to as "1×SGGS" (SEQ ID NO: 174), "2×SGGS" (SEQ ID NO: 446), "3×SGGS" (SEQ ID NO: 3889), "1×XTEN" (SEQ ID NO: 171), "no linker", "1×Gly", "1×Pro", "1×EAAAK" (SEQ ID NO: 3968), "2×EAAAK" "(SEQ ID NO: 3969), and "3×EAAAK" (SEQ ID NO: 3970). The editing efficiency is measured in bar graph format relative to the "control" editing efficiency of PE2. The linker of PE2 is SGGSSGGSSGSETPGTSESATPESSGGSSGGSS (SEQ ID NO: 127). All editing was done in the context of the PE3 system, i.e., which refers the PE2 editing construct plus the addition of the optimal secondary sgRNA nicking guide. See Example 21.

Figure 80:
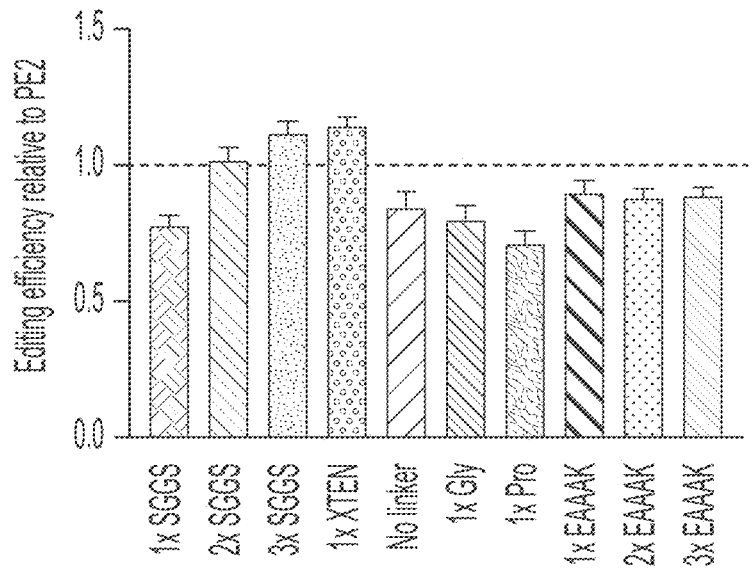

FIG. 80. Taking the average fold efficacy relative to PE2 yields the graph shown, indicating that use of a 1×XTEN (SEQ ID NO: 171) linker sequence improves editing efficiency by 1.14 fold on average (n=15). See Example 21.

Figure 81:
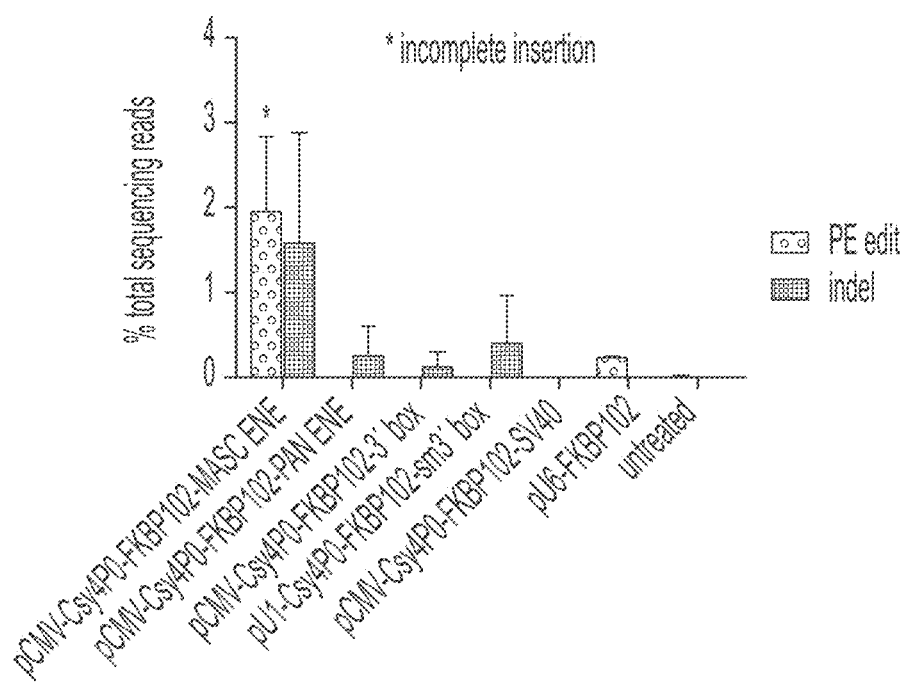

FIG. 81 depicts the transcription level of PEgRNAs from different promoters, as described in Example 22.

Figure 82:
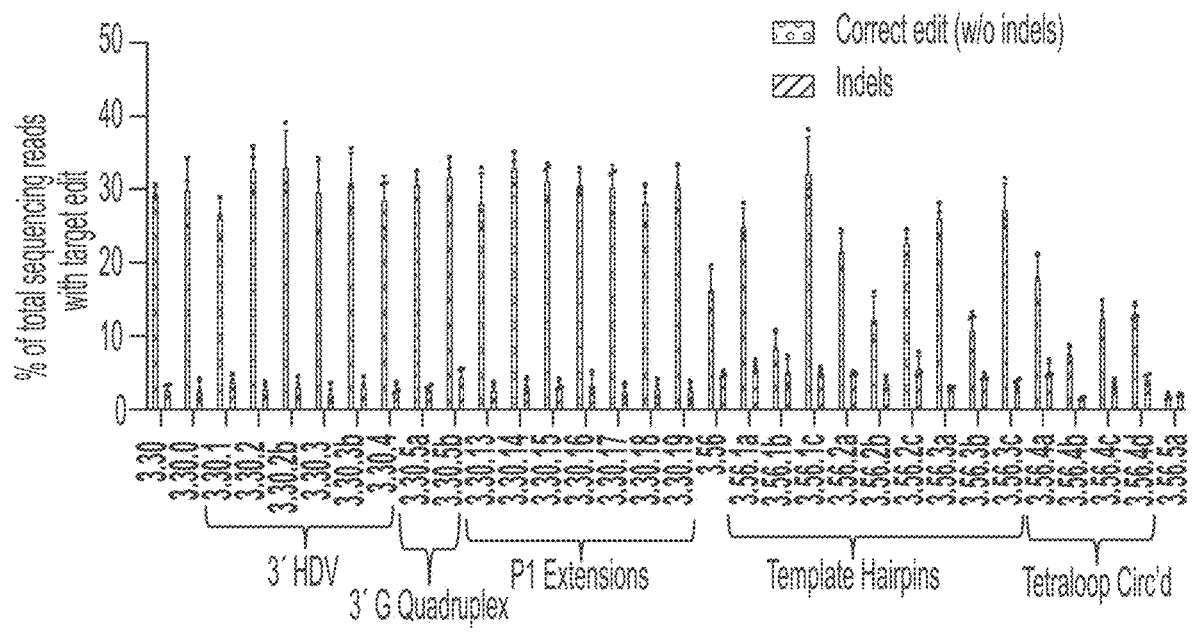

FIG. 82 As depicted in Example 22, impact of different types of modifications on PEgRNA structure on editing efficiency relative to unmodified PEgRNA.

Figure 83:
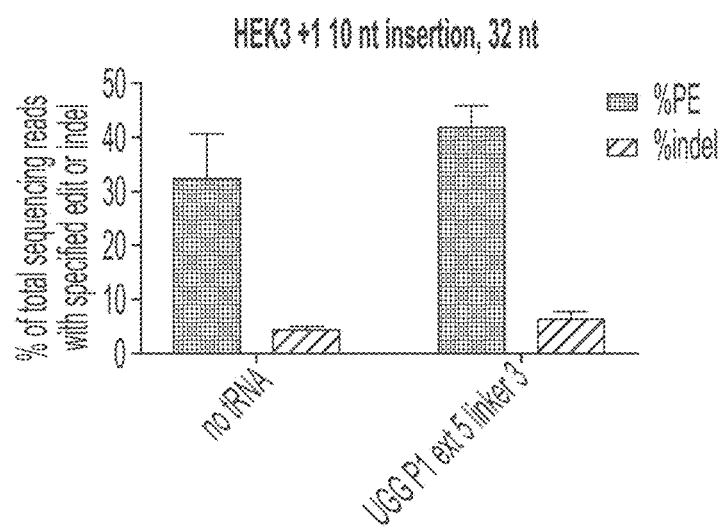

FIG. 83 Depicts a PE experiment that targeted editing of the HEK3 gene, specifically targeting the insertion of a 10 nt insertion at position +1 relative to the nick site and using PE3. See Example 22.

Figure 84A:
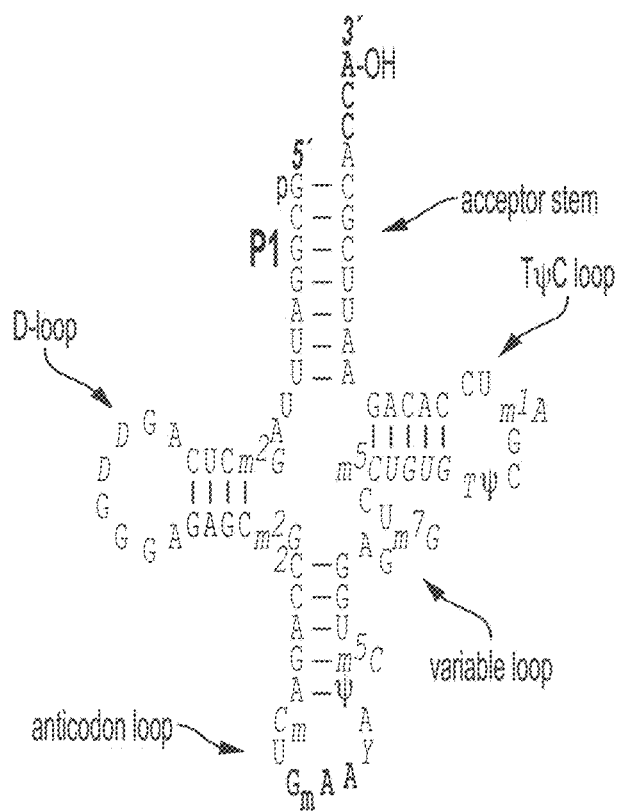

FIG. 84A depicts an exemplary PEgRNA having a spacer, gRNA core, and an extension arm (RT template+primer binding site), which is modified at the 3' end of the PEgRNA with a tRNA molecule, coupled through a UCU linker. The tRNA includes various post-transcriptional modifΨications. Said modification are not required, however.

Figure 84B:
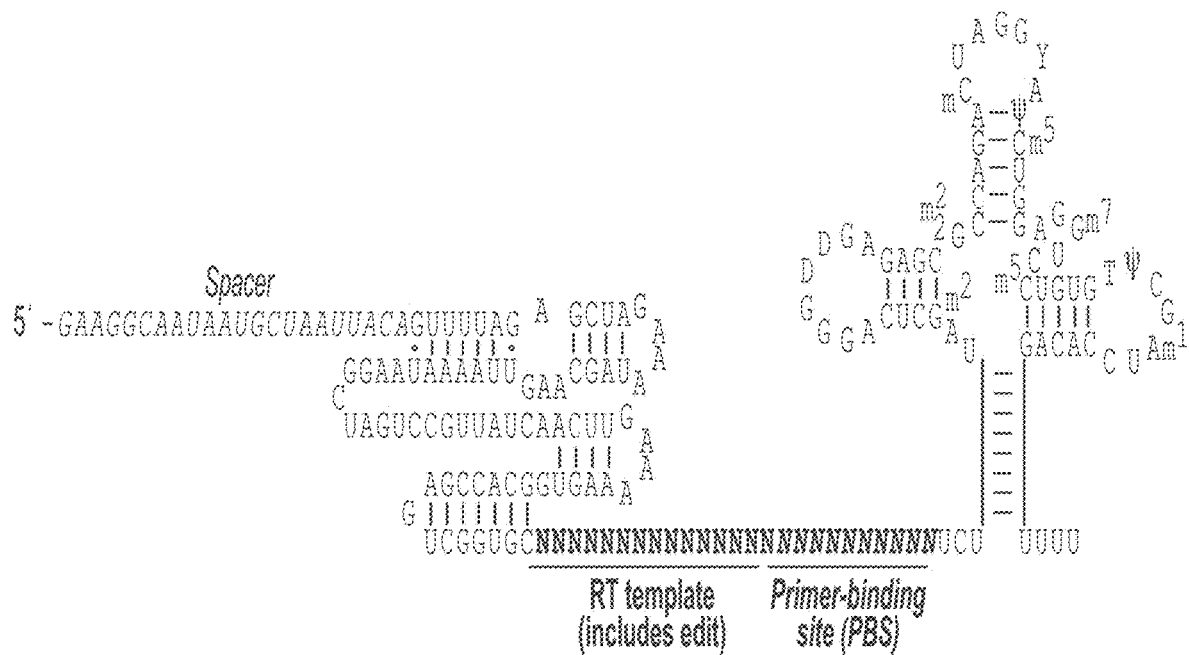

FIG. 84B depicts structure of tRNA that can be used to modify PEgRNA structures. See Example 22. The P1 can be variable in length. The P1 can be extended to help prevent RNAseP processing of the PEgRNA-tRNA fusion.

Figure 85:
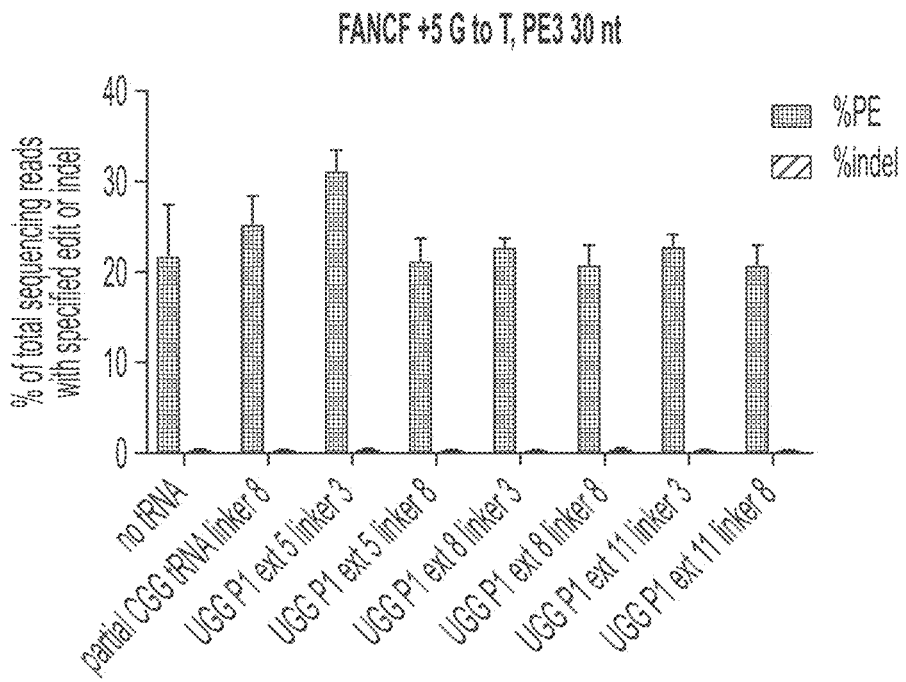

FIG. 85 depicts a PE experiment that targeted editing of the FANCF gene, specifically targeting a G-to-T conversion at position +5 relative to the nick site and using PE3 construct. See Example 22.

Figure 86:
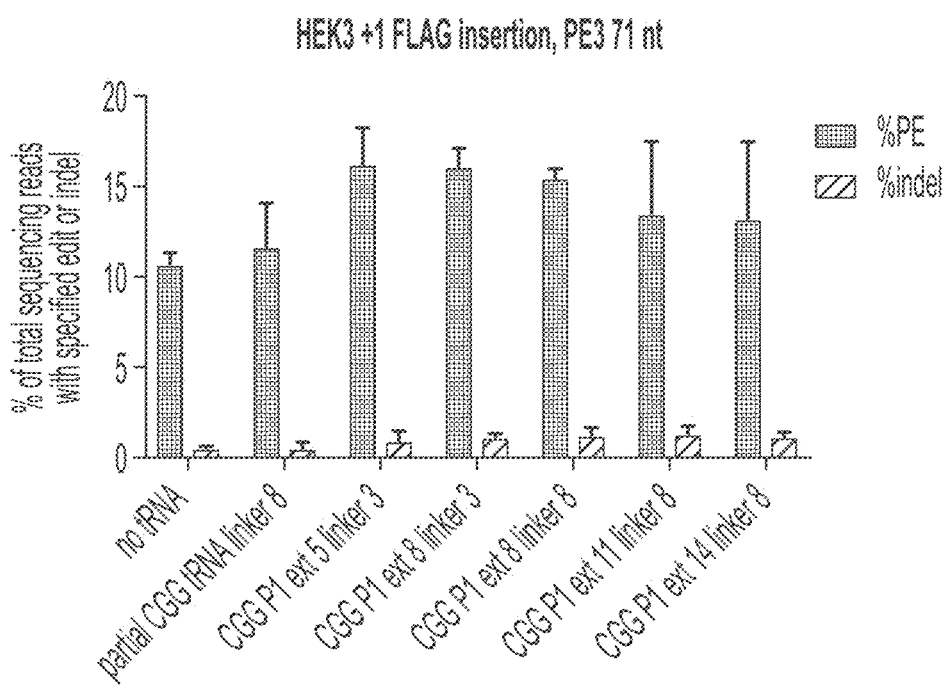

FIG. 86 depicts a PE experiment that targeted editing of the HEK3 gene, specifically targeting the insertion of a 71 nt FLAG tag insertion at position +1 relative to the nick site and using PE3 construct. See Example 22.

Figure 87:
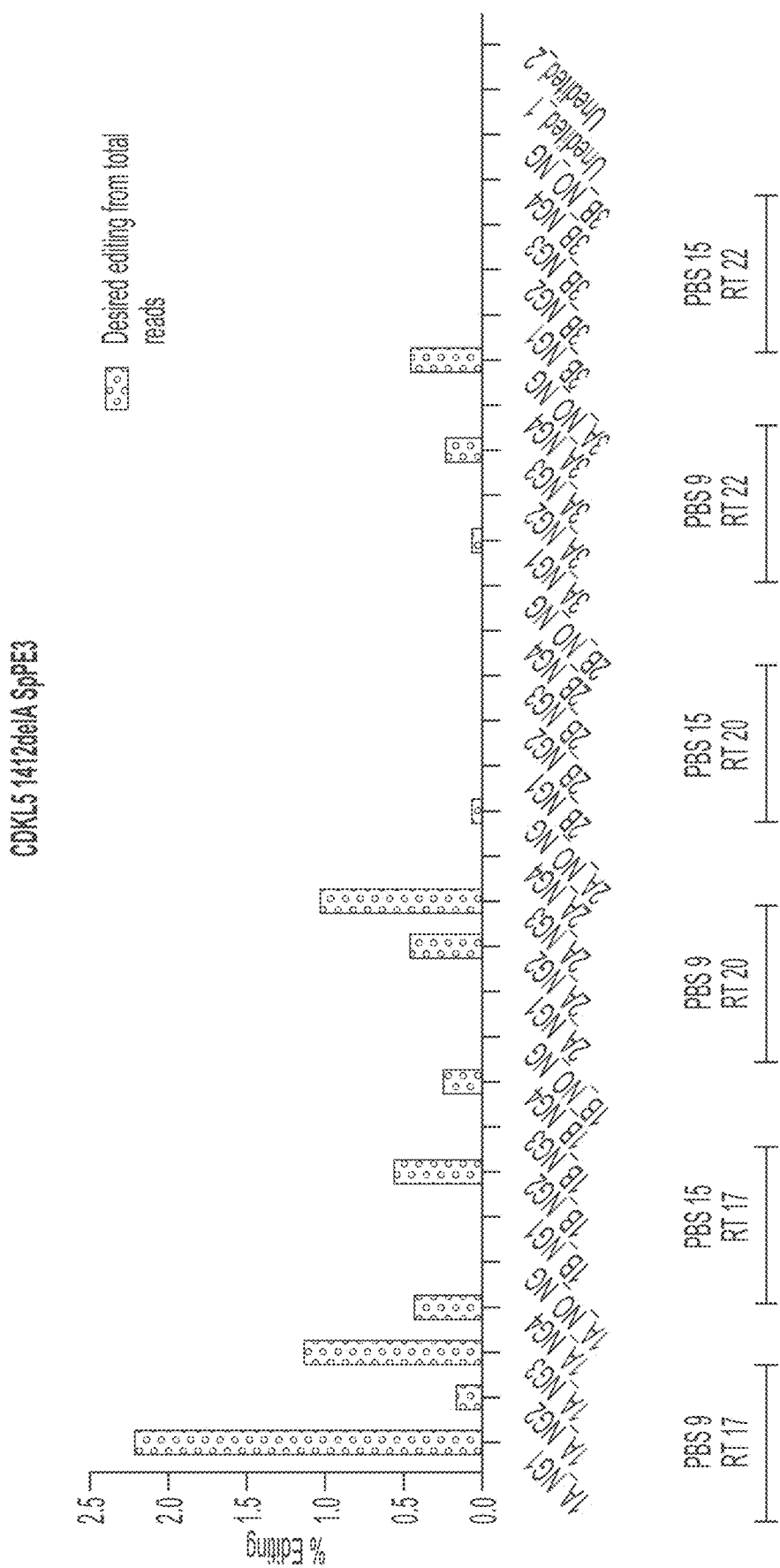

FIG. 87 results from a screen in N2A cells where the pegRNA installs 1412Adel, with details about the primer binding site (PBS) length and reverse transcriptase (RT) template length. (Shown with and without indels). See Example 23.

Figure 88:
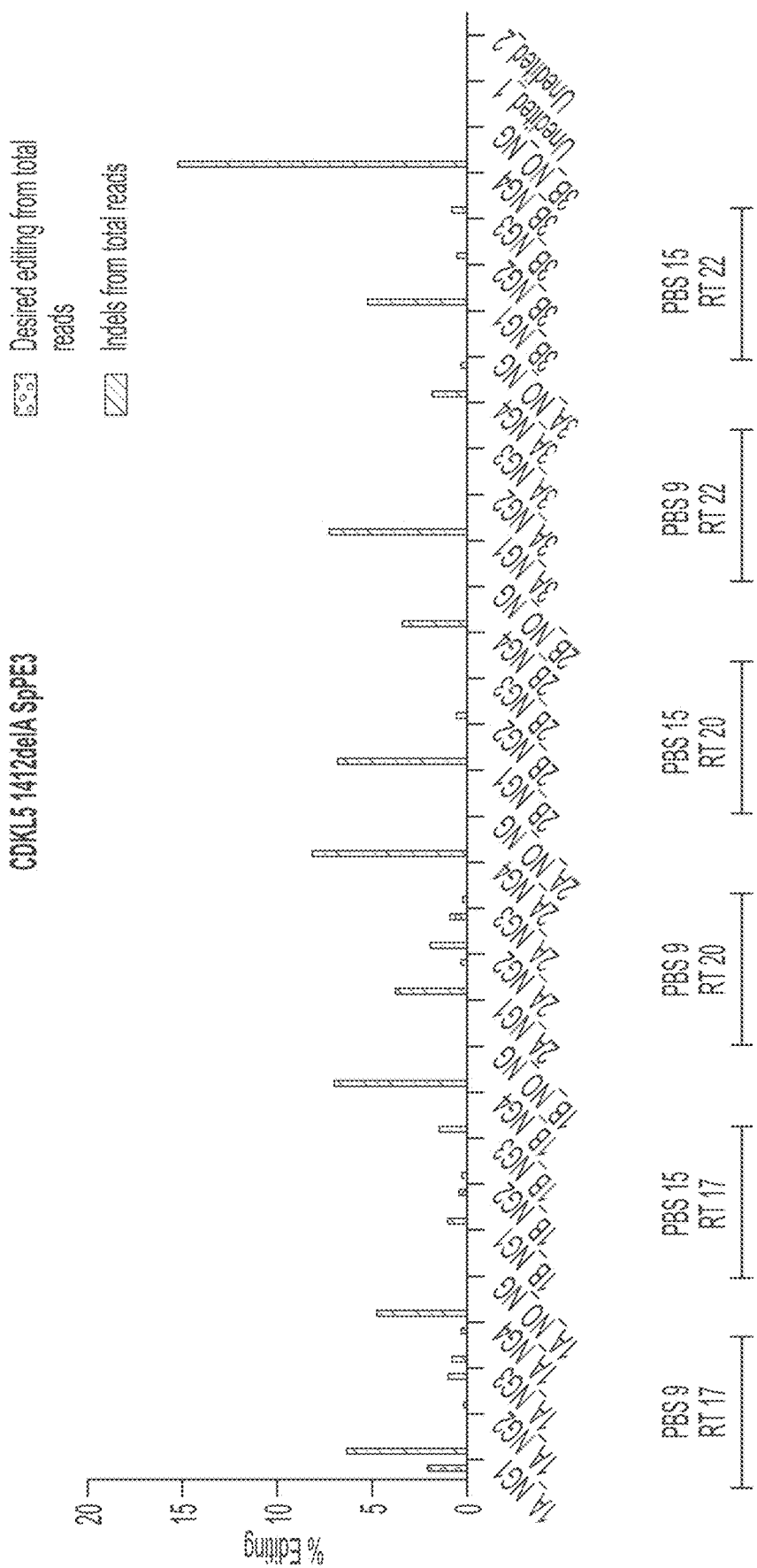

FIG. 88 results from a screen in N2A cells where the pegRNA installs 1412Adel, with details about the primer binding site (PBS) length and reverse transcriptase (RT) template length. (Shown with and without indels). See Example 23.

Figure 89:
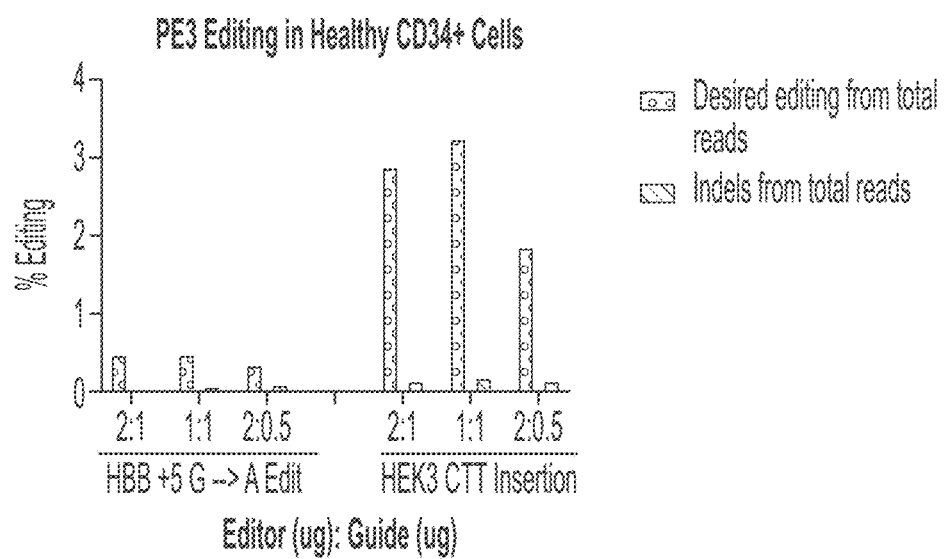

FIG. 89 depicts results of editing at a proxy locus in the β-globin gene and at HEK3 in healthy HSCs, varying the concentration of editor to pegRNA and nicking gRNA. See Example 23.

Figure 90:
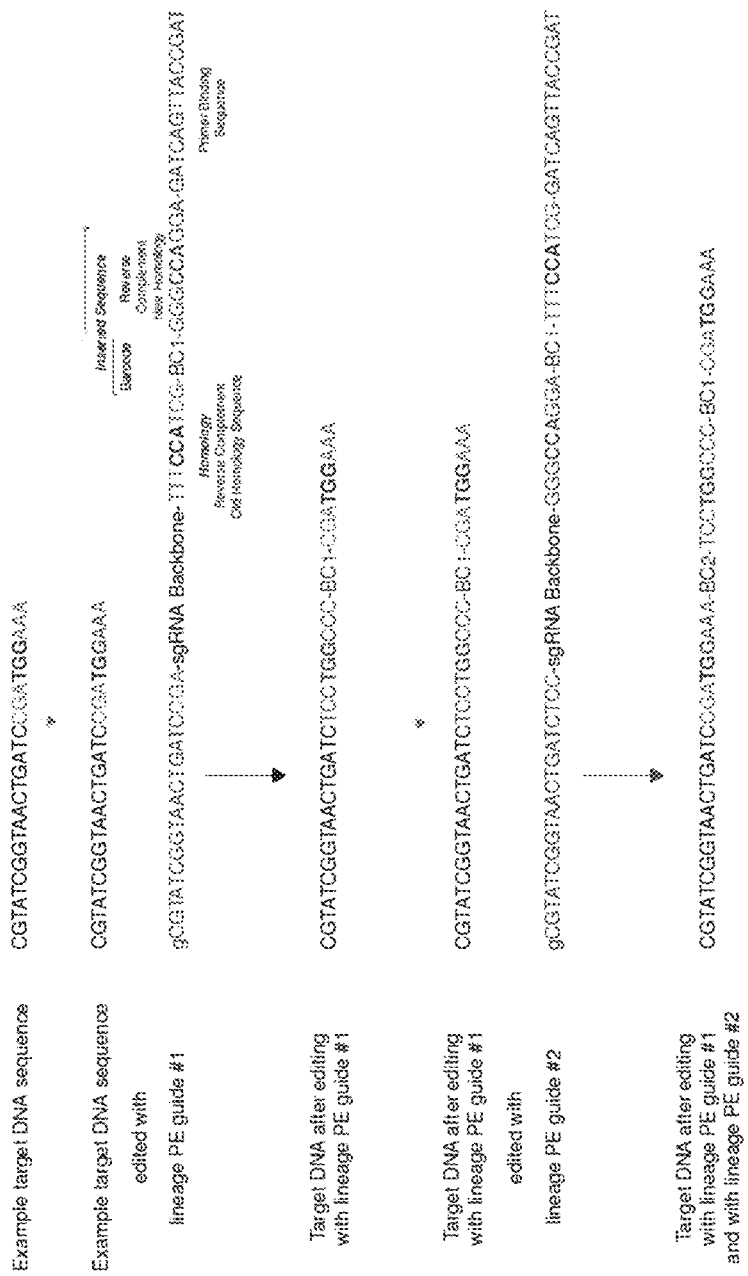

FIG. 90 shows target DNA sequences after editing with various lineage PE guides. From top to bottom, and left to right, the sequences in FIG. 90 correspond to SEQ ID NOs: 752, 752, 753, 754, 754, 755, and 756.

DEFINITIONS

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them unless specified otherwise.

Antisense Strand

In genetics, the "antisense" strand of a segment within double-stranded DNA is the template strand, and which is considered to run in the 3' to 5' orientation. By contrast, the "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

Bi-Specific Ligand

The term "bi-specific ligand" or "bi-specific moiety," as used herein, refers to a ligand that binds to two different ligand-binding domains. In certain embodiments, the ligand is a small molecule compound, or a peptide, or a polypeptide. In other embodiments, ligand-binding domain is a "dimerization domain," which can be install as a peptide tag onto a protein. In various embodiments, two proteins each comprising the same or different dimerization domains can be induced to dimerize through the binding of each dimerization domain to the bi-specific ligand. As used herein, "bi-specific ligands" may be equivalently refer to "chemical inducers of dimerization" or "CIDs".

Cas9

The term "Cas9" or "Cas9 nuclease" refers to an RNA-guided nuclease comprising a Cas9 domain, or a fragment thereof (e.g., a protein comprising an active or inactive DNA cleavage domain of Cas9, and/or the gRNA binding domain of Cas9). A "Cas9 domain" as used herein, is a protein fragment comprising an active or inactive cleavage domain of Cas9 and/or the gRNA binding domain of Cas9. A "Cas9 protein" is a full length Cas9 protein. A Cas9 nuclease is also referred to sometimes as a casn1 nuclease or a CRISPR (Clustered Regularly Interspaced Short Palindromic Repeat)-associated nuclease. CRISPR is an adaptive immune system that provides protection against mobile genetic elements (viruses, transposable elements, and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 domain. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which are hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737; the entire contents of which are incorporated herein by reference. In some embodiments, a Cas9 nuclease comprises one or more mutations that partially impair or inactivate the DNA cleavage domain.

A nuclease-inactivated Cas9 domain may interchangeably be referred to as a "dCas9" protein (for nuclease-"dead" Cas9). Methods for generating a Cas9 domain (or a fragment thereof) having an inactive DNA cleavage domain are known (see, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, at least about 99.8% identical, or at least about 99.9% identical to wild type Cas9 (e.g., SpCas9 of SEQ ID NO: 18). In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9 (e.g., SpCas9 of SEQ ID NO: 18). In some embodiments, the Cas9 variant comprises a fragment of SEQ ID NO: 18 Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9 (e.g., SpCas9 of SEQ ID NO: 18). In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SpCas9 of SEQ ID NO: 18).

cDNA

The term "cDNA" refers to a strand of DNA copied from an RNA template. cDNA is complementary to the RNA template.

Circular Permutant

As used herein, the term "circular permutant" refers to a protein or polypeptide (e.g., a Cas9) comprising a circular permutation, which is change in the protein's structural configuration involving a change in order of amino acids appearing in the protein's amino acid sequence. In other words, circular permutants are proteins that have altered N- and C-termini as compared to a wild-type counterpart, e.g., the wild-type C-terminal half of a protein becomes the new N-terminal half. Circular permutation (or CP) is essentially the topological rearrangement of a protein's primary sequence, connecting its N- and C-terminus, often with a peptide linker, while concurrently splitting its sequence at a different position to create new, adjacent N- and C-termini. The result is a protein structure with different connectivity, but which often can have the same overall similar three-dimensional (3D) shape, and possibly include improved or altered characteristics, including, reduced proteolytic susceptibility, improved catalytic activity, altered substrate or ligand binding, and/or improved thermostability. Circular permutant proteins can occur in nature (e.g., concanavalin A and lectin). In addition, circular permutation can occur as a result of posttranslational modifications or may be engineered using recombinant techniques.

Circularly Permuted Cas9

The term "circularly permuted Cas9" refers to any Cas9 protein, or variant thereof, that has been occurs as a circular permutant, whereby its N- and C-termini have been topically rearranged. Such circularly permuted Cas9 proteins ("CP-Cas9"), or variants thereof, retain the ability to bind DNA when complexed with a guide RNA (gRNA). See, Oakes et al., "Protein Engineering of Cas9 for enhanced function," *Methods Enzymol*, 2014, 546: 491-511 and Oakes et al., "CRISPR-Cas9 Circular Permutants as Programmable Scaffolds for Genome Modification," *Cell*, Jan. 10, 2019, 176: 254-267, each of are incorporated herein by reference. The instant disclosure contemplates any previously known CP-Cas9 or use a new CP-Cas9 so long as the resulting circularly permuted protein retains the ability to bind DNA when complexed with a guide RNA (gRNA). Exemplary CP-Cas9 proteins are SEQ ID NOs: 77-86.

CRISPR

CRISPR is a family of DNA sequences (i.e., CRISPR clusters) in bacteria and archaea that represent snippets of prior infections by a virus that have invaded the prokaryote. The snippets of DNA are used by the prokaryotic cell to detect and destroy DNA from subsequent attacks by similar viruses and effectively compose, along with an array of CRISPR-associated proteins (including Cas9 and homologs thereof) and CRISPR-associated RNA, a prokaryotic immune defense system. In nature, CRISPR clusters are transcribed and processed into CRISPR RNA (crRNA). In certain types of CRISPR systems (e.g., type II CRISPR systems), correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species—the guide RNA. See, e.g., Jinek M., Chylinski K., Fonfara I., Hauer M., Doudna J. A., Charpentier E. Science 337:816-821(2012), the entire contents of which is hereby incorporated by reference. Cas9 recognizes a short motif in the CRISPR repeat sequences (the PAM or protospacer adjacent motif) to help distinguish self versus non-self. CRISPR biology, as well as Cas9 nuclease sequences and structures are well known to those of skill in the art (see, e.g., "Complete genome sequence of an M1 strain of Streptococcus pyogenes." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, S. pyogenes and S. thermophilus. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In certain types of CRISPR systems (e.g., type II CRISPR systems), correct processing of pre-crRNA requires a trans-encoded small RNA (tracrRNA), endogenous ribonuclease 3 (rnc), and a Cas9 protein. The tracrRNA serves as a guide for ribonuclease 3-aided processing of pre-crRNA. Subsequently, Cas9/crRNA/tracrRNA endonucleolytically cleaves linear or circular nucleic acid target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate embodiments of both the crRNA and tracrRNA into a single RNA species—the guide RNA.

In general, a "CRISPR system" refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr mate sequence (encompassing a "direct repeat" and a tracrRNA-processed partial direct repeat in the context of an endogenous CRISPR system), a guide sequence (also referred to as a "spacer" in the context of an endogenous CRISPR system), or other sequences and transcripts from a CRISPR locus. The tracrRNA of the system is complementary (fully or partially) to the tracr mate sequence present on the guide RNA.

DNA Synthesis Template

As used herein, the term "DNA synthesis template" refers to the region or portion of the extension arm of a PEgRNA that is utilized as a template strand by a polymerase of a prime editor to encode a 3' single-strand DNA flap that contains the desired edit and which then, through the mechanism of prime editing, replaces the corresponding endogenous strand of DNA at the target site. In various embodiments, the DNA synthesis template is shown in FIG. 3A (in the context of a PEgRNA comprising a 5' extension arm), FIG. 3B (in the context of a PEgRNA comprising a 3' extension arm), FIG. 3C (in the context of an internal extension arm), FIG. 3D (in the context of a 3' extension arm), and FIG. 3E (in the context of a 5' extension arm). The extension arm, including the DNA synthesis template, may be comprised of DNA or RNA. In the case of RNA, the polymerase of the prime editor can be an RNA-dependent DNA polymerase (e.g., a reverse transcriptase). In the case of DNA, the polymerase of the prime editor can be a DNA-dependent DNA polymerase. In various embodiments (e.g., as depicted in FIGS. 3D-3E), the DNA synthesis template (4) may comprise the "edit template" and the "homology arm", and all or a portion of the optional 5' end modifier region, e2. That is, depending on the nature of the e2 region (e.g., whether it includes a hairpin, toeloop, or stem/loop secondary structure), the polymerase may encode none, some, or all of the e2 region, as well. Said another way, in the case of a 3' extension arm, the DNA synthesis template (3) can include the portion of the extension arm (3) that spans from the 5' end of the primer binding site (PBS) to 3' end of the gRNA core that may operate as a template for the synthesis of a single-strand of DNA by a polymerase (e.g., a reverse transcriptase). In the case of a 5' extension arm, the DNA synthesis template (3) can include the portion of the extension arm (3) that spans from the 5' end of the PEgRNA molecule to the 3' end of the edit template. Preferably, the DNA synthesis template excludes the primer binding site (PBS) of PEgRNAs either having a 3' extension arm or a 5' extension arm. Certain embodiments described here (e.g, FIG. 71A) refer to an "an RT template," which is inclusive of the edit template and the homology arm, i.e., the sequence of the PEgRNA extension arm which is actually used as a template during DNA synthesis. The term "RT template" is equivalent to the term "DNA synthesis template."

In the case of trans prime editing (e.g., FIG. 3G and FIG. 3H), the primer binding site (PBS) and the DNA synthesis template can be engineered into a separate molecule referred to as a trans prime editor RNA template (tPERT).

Dimerization Domain

The term "dimerization domain" refers to a ligand-binding domain that binds to a binding moiety of a bi-specific ligand. A "first" dimerization domain binds to a first binding moiety of a bi-specific ligand and a "second" dimerization domain binds to a second binding moiety of the same bi-specific ligand. When the first dimerization domain is fused to a first protein (e.g., via PE, as discussed herein) and the second dimerization domain (e.g., via PE, as discussed herein) is fused to a second protein, the first and second protein dimerize in the presence of a bi-specific ligand, wherein the bi-specific ligand has at least one moiety that binds to the first dimerization domain and at least another moiety that binds to the second dimerization domain.

Downstream

As used herein, the terms "upstream" and "downstream" are terms of relativity that define the linear position of at least two elements located in a nucleic acid molecule (whether single or double-stranded) that is orientated in a 5'-to-3' direction. In particular, a first element is upstream of a second element in a nucleic acid molecule where the first element is positioned somewhere that is 5' to the second element. For example, a SNP is upstream of a Cas9-induced nick site if the SNP is on the 5' side of the nick site. Conversely, a first element is downstream of a second element in a nucleic acid molecule where the first element is positioned somewhere that is 3' to the second element. For example, a SNP is downstream of a Cas9-induced nick site if the SNP is on the 3' side of the nick site. The nucleic acid molecule can be a DNA (double or single stranded), RNA (double or single stranded), or a hybrid of DNA and RNA. The analysis is the same for single strand nucleic acid molecule and a double strand molecule since the terms upstream and downstream are in reference to only a single strand of a nucleic acid molecule, except that one needs to select which strand of the double stranded molecule is being considered. Often, the strand of a double stranded DNA which can be used to determine the positional relativity of at least two elements is the "sense" or "coding" strand. In genetics, a "sense" strand is the segment within double-stranded DNA that runs from 5' to 3', and which is complementary to the antisense strand of DNA, or template strand, which runs from 3' to 5'. Thus, as an example, a SNP nucleobase is "downstream" of a promoter sequence in a genomic DNA (which is double-stranded) if the SNP nucleobase is on the 3' side of the promoter on the sense or coding strand.

Edit Template

The term "edit template" refers to a portion of the extension arm that encodes the desired edit in the single strand 3' DNA flap that is synthesized by the polymerase, e.g., a DNA-dependent DNA polymerase, RNA-dependent DNA polymerase (e.g., a reverse transcriptase). Certain embodiments described here (e.g., FIG. 71A) refer to "an RT template," which refers to both the edit template and the homology arm together, i.e., the sequence of the PEgRNA extension arm which is actually used as a template during DNA synthesis. The term "RT edit template" is also equivalent to the term "DNA synthesis template," but wherein the RT edit template reflects the use of a prime editor having a polymerase that is a reverse transcriptase, and wherein the DNA synthesis template reflects more broadly the use of a prime editor having any polymerase.

Effective Amount

The term "effective amount," as used herein, refers to an amount of a biologically active agent that is sufficient to elicit a desired biological response. For example, in some embodiments, an effective amount of a prime editor (PE) may refer to the amount of the editor that is sufficient to edit a target site nucleotide sequence, e.g., a genome. In some embodiments, an effective amount of a prime editor (PE) provided herein, e.g., of a fusion protein comprising a nickase Cas9 domain and a reverse transcriptase may refer to the amount of the fusion protein that is sufficient to induce editing of a target site specifically bound and edited by the fusion protein. As will be appreciated by the skilled artisan, the effective amount of an agent, e.g., a fusion protein, a nuclease, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

Error-Prone Reverse Transcriptase

As used herein, the term "error-prone" reverse transcriptase (or more broadly, any polymerase) refers to a reverse transcriptase (or more broadly, any polymerase) that occurs naturally or which has been derived from another reverse transcriptase (e.g., a wild type M-MLV reverse transcriptase) which has an error rate that is less than the error rate of wild type M-MLV reverse transcriptase. The error rate of wild type M-MLV reverse transcriptase is reported to be in the range of one error in 15,000 (higher) to 27,000 (lower). An error rate of 1 in 15,000 corresponds with an error rate of $6.7 \times 10^{-5}$. An error rate of 1 in 27,000 corresponds with an error rate of $3.7 \times 10^{-5}$. See Boutabout et al. (2001) "DNA synthesis fidelity by the reverse transcriptase of the yeast retrotransposon Ty1," *Nucleic Acids Res* 29(11):2217-2222, which is incorporated herein by reference. Thus, for purposes of this application, the term "error prone" refers to those RT that have an error rate that is greater than one error in 15,000 nucleobase incorporation ($6.7 \times 10^{-5}$ or higher), e.g., 1 error in 14,000 nucleobases ($7.14 \times 10^{-5}$ or higher), 1 error in 13,000 nucleobases or fewer ($7.7 \times 10^{-5}$ or higher), 1 error in 12,000 nucleobases or fewer ($7.7 \times 10^{-5}$ or higher), 1 error in 11,000 nucleobases or fewer ($9.1 \times 10^{-5}$ or higher), 1 error in 10,000 nucleobases or fewer ($1 \times 10^{-4}$ or 0.0001 or higher), 1 error in 9,000 nucleobases or fewer (0.00011 or higher), 1 error in 8,000 nucleobases or fewer (0.00013 or higher) 1 error in 7,000 nucleobases or fewer (0.00014 or higher), 1 error in 6,000 nucleobases or fewer (0.00016 or higher), 1 error in 5,000 nucleobases or fewer (0.0002 or higher), 1 error in 4,000 nucleobases or fewer (0.00025 or higher), 1 error in 3,000 nucleobases or fewer (0.00033 or higher), 1 error in 2,000 nucleobase or fewer (0.00050 or higher), or 1 error in 1,000 nucleobases or fewer (0.001 or higher), or 1 error in 500 nucleobases or fewer (0.002 or higher), or 1 error in 250 nucleobases or fewer (0.004 or higher).

Extein

The term "extein," as used herein, refers to an polypeptide sequence that is flanked by an intein and is ligated to another extein during the process of protein splicing to form a mature, spliced protein. Typically, an intein is flanked by two extein sequences that are ligated together when the intein catalyzes its own excision. Exteins, accordingly, are the protein analog to exons found in mRNA. For example, a polypeptide comprising an intein may be of the structure extein(N)-intein-extein(C). After excision of the intein and splicing of the two exteins, the resulting structures are extein(N)-extein(C) and a free intein. In various configurations, the exteins may be separate proteins (e.g., half of a Cas9 or PE fusion protein), each fused to a split-intein, wherein the excision of the split inteins causes the splicing together of the extein sequences.

Extension Arm

The term "extension arm" refers to a nucleotide sequence component of a PEgRNA which provides several functions, including a primer binding site and an edit template for reverse transcriptase. In some embodiments, e.g., FIG. 3D, the extension arm is located at the 3' end of the guide RNA. In other embodiments, e.g., FIG. 3E, the extension arm is located at the 5' end of the guide RNA. In some embodiments, the extension arm also includes a homology arm. In various embodiments, the extension arm comprises the following components in a 5' to 3' direction: the homology arm, the edit template, and the primer binding site. Since polymerization activity of the reverse transcriptase is in the 5' to 3' direction, the preferred arrangement of the homology arm, edit template, and primer binding site is in the 5' to 3' direction such that the reverse transcriptase, once primed by an annealed primer sequence, polymerases a single strand of DNA using the edit template as a complementary template strand. Further details, such as the length of the extension arm, are described elsewhere herein.

The extension arm may also be described as comprising generally two regions: a primer binding site (PBS) and a DNA synthesis template, as shown in FIG. 3G (top), for instance. The primer binding site binds to the primer sequence that is formed from the endogenous DNA strand of the target site when it becomes nicked by the prime editor complex, thereby exposing a 3' end on the endogenous nicked strand. As explained herein, the binding of the primer sequence to the primer binding site on the extension arm of the PEgRNA creates a duplex region with an exposed 3' end (i.e., the 3' of the primer sequence), which then provides a substrate for a polymerase to begin polymerizing a single strand of DNA from the exposed 3' end along the length of the DNA synthesis template. The sequence of the single strand DNA product is the complement of the DNA synthesis template. Polymerization continues towards the 5' of the DNA synthesis template (or extension arm) until polymerization terminates. Thus, the DNA synthesis template represents the portion of the extension arm that is encoded into a single strand DNA product (i.e., the 3' single strand DNA flap containing the desired genetic edit information) by the polymerase of the prime editor complex and which ultimately replaces the corresponding endogenous DNA strand of the target site that sits immediate downstream of the PE-induced nick site. Without being bound by theory, polymerization of the DNA synthesis template continues towards the 5' end of the extension arm until a termination event. Polymerization may terminate in a variety of ways, including, but not limited to (a) reaching a 5' terminus of the PEgRNA (e.g., in the case of the 5' extension arm wherein the DNA polymerase simply runs out of template), (b) reaching an impassable RNA secondary structure (e.g., hairpin or stem/loop), or (c) reaching a replication termination signal, e.g., a specific nucleotide sequence that blocks or inhibits the polymerase, or a nucleic acid topological signal, such as, supercoiled DNA or RNA.

Flap Endonuclease (e.g., FEN1)

As used herein, the term "flap endonuclease" refers to an enzyme that catalyzes the removal of 5' single strand DNA flaps. These are naturally occurring enzymes that process the removal of 5' flaps formed during cellular processes, including DNA replication. The prime editing methods herein described may utilize endogenously supplied flap endonucleases or those provided in trans to remove the 5' flap of endogenous DNA formed at the target site during prime editing. Flap endonucleases are known in the art and can be found described in Patel et al., "Flap endonucleases pass 5'-flaps through a flexible arch using a disorder-thread-order mechanism to confer specificity for free 5'-ends," *Nucleic Acids Research*, 2012, 40(10): 4507-4519, Tsutakawa et al., "Human flap endonuclease structures, DNA double-base flipping, and a unified understanding of the FEN1 superfamily," *Cell*, 2011, 145(2): 198-211, and Balakrishnan et al., "Flap Endonuclease 1," *Annu Rev Biochem*, 2013, Vol 82: 119-138 (each of which are incorporated herein by reference). An exemplary flap endonuclease is FEN1, which can be represented by the following amino acid sequence:

| DESCRIPTION | SEQUENCE | SEQ ID NO: |
|---|---|---|
| FEN1 WILD TYPE | MGIQGLAKLIADVAPSAIRENDIKSYFGRKVAIDASMSI YQFLIAVRQGGDVLQNEEGETTSHLMGMFYRT1RMME NGIKPVYVFDGKPPQLKSGELAKRSERRAEAEKQLQQ AQAAGAEQEVEKFTKRLVKVTKQHNDECKHLLSLMGI PYLDAPSEAEASCAALVKAGKVYAAATEDMDCLTFGS PVLMRHLTASEAKKLPIQEFHLSRILQELGLNQEQFVDL CILLGSDYCESIRGIGPKRAVDLIQKHKSIEEIVRRLDPN KYPVPENWLHKEAHQLFLEPEVLDPESVELKWSEPNE EELIKFMCGEKQFSEERIRSGVKRLSKSRQGSTQGRLD DFFKVTGSLSSAKRKEPEPKGSTKKKAKTGAAGKFKR GK | SEQ ID NO: 7 |

Functional Equivalent

The term "functional equivalent" refers to a second biomolecule that is equivalent in function, but not necessarily equivalent in structure to a first biomolecule. For example, a "Cas9 equivalent" refers to a protein that has the same or substantially the same functions as Cas9, but not necessarily the same amino acid sequence. In the context of the disclosure, the specification refers throughout to "a protein X, or a functional equivalent thereof." In this context, a "functional equivalent" of protein X embraces any homolog, paralog, fragment, naturally occurring, engineered, mutated, or synthetic version of protein X which bears an equivalent function.

Fusion Protein

The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. Another example includes a Cas9 or equivalent thereof to a reverse transcriptase. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

Gene of Interest (GOI)

The term "gene of interest" or "GOI" refers to a gene that encodes a biomolecule of interest (e.g., a protein or an RNA molecule). A protein of interest can include any intracellular protein, membrane protein, or extracellular protein, e.g., a nuclear protein, transcription factor, nuclear membrane transporter, intracellular organelle associated protein, a membrane receptor, a catalytic protein, and enzyme, a therapeutic protein, a membrane protein, a membrane transport protein, a signal transduction protein, or an immunological protein (e.g., an IgG or other antibody protein), etc. The gene of interest may also encode an RNA molecule, including, but not limited to, messenger RNA (mRNA), transfer RNA (tRNA), ribosomal RNA (rRNA), small nuclear RNA (snRNA), antisense RNA, guide RNA, microRNA (miRNA), small interfering RNA (siRNA), and cell-free RNA (cfRNA).

Guide RNA ("gRNA")

As used herein, the term "guide RNA" is a particular type of guide nucleic acid which is mostly commonly associated with a Cas protein of a CRISPR-Cas9 and which associates with Cas9, directing the Cas9 protein to a specific sequence in a DNA molecule that includes complementarity to protospacer sequence of the guide RNA. However, this term also embraces the equivalent guide nucleic acid molecules that associate with Cas9 equivalents, homologs, orthologs, or paralogs, whether naturally occurring or non-naturally occurring (e.g., engineered or recombinant), and which otherwise program the Cas9 equivalent to localize to a specific target nucleotide sequence. The Cas9 equivalents may include other napDNAbp from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference. Exemplary sequences are and structures of guide RNAs are provided herein. In addition, methods for designing appropriate guide RNA sequences are provided herein. As used herein, the "guide RNA" may also be referred to as a "traditional guide RNA" to contrast it with the modified forms of guide RNA termed "prime editing guide RNAs" (or "PEgRNAs") which have been invented for the prime editing methods and composition disclosed herein.

Guide RNAs or PEgRNAs may comprise various structural elements that include, but are not limited to:

Spacer sequence—the sequence in the guide RNA or PEgRNA (having about 20 nts in length) which binds to the protospacer in the target DNA.

gRNA core (or gRNA scaffold or backbone sequence)—refers to the sequence within the gRNA that is responsible for Cas9 binding, it does not include the 20 bp spacer/targeting sequence that is used to guide Cas9 to target DNA.

Extension arm—a single strand extension at the 3' end or the 5' end of the PEgRNA which comprises a primer binding site and a DNA synthesis template sequence that encodes via a polymerase (e.g., a reverse transcriptase) a single stranded DNA flap containing the genetic change of interest, which then integrates into the endogenous DNA by replacing the corresponding endogenous strand, thereby installing the desired genetic change.

Transcription terminator—the guide RNA or PEgRNA may comprise a transcriptional termination sequence at the 3' of the molecule.

Homology Arm

The term "homology arm" refers to a portion of the extension arm that encodes a portion of the resulting reverse transcriptase-encoded single strand DNA flap that is to be integrated into the target DNA site by replacing the endogenous strand. The portion of the single strand DNA flap encoded by the homology arm is complementary to the non-edited strand of the target DNA sequence, which facilitates the displacement of the endogenous strand and annealing of the single strand DNA flap in its place, thereby installing the edit. This component is further defined elsewhere. The homology arm is part of the DNA synthesis template since it is by definition encoded by the polymerase of the prime editors described herein.

Host Cell

The term "host cell," as used herein, refers to a cell that can host, replicate, and express a vector described herein, e.g., a vector comprising a nucleic acid molecule encoding a fusion protein comprising a Cas9 or Cas9 equivalent and a reverse transcriptase.

Inteins

As used herein, the term "intein" refers to auto-processing polypeptide domains found in organisms from all domains of life. An intein (intervening protein) carries out a unique auto-processing event known as protein splicing in which it excises itself out from a larger precursor polypeptide through the cleavage of two peptide bonds and, in the process, ligates the flanking extein (external protein) sequences through the formation of a new peptide bond. This rearrangement occurs post-translationally (or possibly co-translationally), as intein genes are found embedded in frame within other protein-coding genes. Furthermore, intein-mediated protein splicing is spontaneous; it requires no external factor or energy source, only the folding of the intein domain. This process is also known as cis-protein splicing, as opposed to the natural process of trans-protein splicing with "split inteins." Inteins are the protein equivalent of the self-splicing RNA introns (see Perler et al., Nucleic Acids Res. 22:1125-1127 (1994)), which catalyze their own excision from a precursor protein with the concomitant fusion of the flanking protein sequences, known as exteins (reviewed in Perler et al., Curr. Opin. Chem. Biol. 1:292-299 (1997); Perler, F. B. Cell 92(1):1-4 (1998); Xu et al., EMBO J. 15(19):5146-5153 (1996)).

As used herein, the term "protein splicing" refers to a process in which an interior region of a precursor protein (an intein) is excised and the flanking regions of the protein (exteins) are ligated to form the mature protein. This natural process has been observed in numerous proteins from both prokaryotes and eukaryotes (Perler, F. B., Xu, M. Q., Paulus, H. Current Opinion in Chemical Biology 1997, 1, 292-299; Perler, F. B. Nucleic Acids Research 1999, 27, 346-347). The intein unit contains the necessary components needed to catalyze protein splicing and often contains an endonuclease domain that participates in intein mobility (Perler, F. B., Davis, E. O., Dean, G. E., Gimble, F. S., Jack, W. E., Neff, N., Noren, C. J., Thomer, J., Belfort, M. Nucleic Acids Research 1994, 22, 1127-1127). The resulting proteins are linked, however, not expressed as separate proteins. Protein splicing may also be conducted in trans with split inteins expressed on separate polypeptides spontaneously combine to form a single intein which then undergoes the protein splicing process to join to separate proteins.

The elucidation of the mechanism of protein splicing has led to a number of intein-based applications (Comb, et al., U.S. Pat. No. 5,496,714; Comb, et al., U.S. Pat. No. 5,834,247; Camarero and Muir, J. Amer. Chem. Soc., 121:5597-5598 (1999); Chong, et al., Gene, 192:271-281 (1997), Chong, et al., Nucleic Acids Res., 26:5109-5115 (1998); Chong, et al., J. Biol. Chem., 273:10567-10577 (1998); Cotton, et al. J. Am. Chem. Soc., 121:1100-1101 (1999); Evans, et al., J. Biol. Chem., 274:18359-18363 (1999); Evans, et al., J. Biol. Chem., 274:3923-3926 (1999); Evans, et al., Protein Sci., 7:2256-2264 (1998); Evans, et al., J. Biol. Chem., 275:9091-9094 (2000); Iwai and Pluckthun, FEBS Lett. 459:166-172 (1999); Mathys, et al., Gene, 231:1-13 (1999); Mills, et al., Proc. Natl. Acad. Sci. USA 95:3543-3548 (1998); Muir, et al., Proc. Natl. Acad. Sci. USA 95:6705-6710 (1998); Otomo, et al., Biochemistry 38:16040-16044 (1999); Otomo, et al., J. Biolmol. NMR 14:105-114 (1999); Scott, et al., Proc. Natl. Acad. Sci. USA 96:13638-13643 (1999); Severinov and Muir, J. Biol. Chem., 273:16205-16209 (1998); Shingledecker, et al., Gene, 207:187-195 (1998); Southworth, et al., EMBO J. 17:918-926 (1998); Southworth, et al., Biotechniques, 27:110-120 (1999); Wood, et al., Nat. Biotechnol., 17:889-892 (1999); Wu, et al., Proc. Natl. Acad. Sci. USA 95:9226-9231 (1998a); Wu, et al., Biochim Biophys Acta 1387:422-432 (1998b); Xu, et al., Proc. Natl. Acad. Sci. USA 96:388-393 (1999); Yamazaki, et al., J. Am. Chem. Soc., 120:5591-5592 (1998)). Each reference is incorporated herein by reference.

Ligand-Dependent Intein

The term "ligand-dependent intein," as used herein refers to an intein that comprises a ligand-binding domain. Typically, the ligand-binding domain is inserted into the amino acid sequence of the intein, resulting in a structure intein (N)-ligand-binding domain-intein (C). Typically, ligand-dependent inteins exhibit no or only minimal protein splicing activity in the absence of an appropriate ligand, and a marked increase of protein splicing activity in the presence of the ligand. In some embodiments, the ligand-dependent intein does not exhibit observable splicing activity in the absence of ligand but does exhibit splicing activity in the presence of the ligand. In some embodiments, the ligand-dependent intein exhibits an observable protein splicing activity in the absence of the ligand, and a protein splicing activity in the presence of an appropriate ligand that is at least 5 times, at least 10 times, at least 50 times, at least 100 times, at least 150 times, at least 200 times, at least 250 times, at least 500 times, at least 1000 times, at least 1500 times, at least 2000 times, at least 2500 times, at least 5000 times, at least 10000 times, at least 20000 times, at least 25000 times, at least 50000 times, at least 100000 times, at least 500000 times, or at least 1000000 times greater than the activity observed in the absence of the ligand. In some embodiments, the increase in activity is dose dependent over at least 1 order of magnitude, at least 2 orders of magnitude, at least 3 orders of magnitude, at least 4 orders of magnitude, or at least 5 orders of magnitude, allowing for fine-tuning of intein activity by adjusting the concentration of the ligand. Suitable ligand-dependent inteins are known in the art, and in include those provided below and those described in published U.S. Patent Application U.S. 2014/0065711 A1; Mootz et al., "Protein splicing triggered by a small molecule." *J. Am. Chem. Soc.* 2002; 124, 9044-9045; Mootz et al., "Conditional protein splicing: a new tool to control protein structure and function in vitro and in vivo." *J. Am. Chem. Soc.* 2003; 125, 10561-10569; Buskirk et al., *Proc. Natl. Acad. Sci. USA.* 2004; 101, 10505-10510); Skretas & Wood, "Regulation of protein activity with small-molecule-controlled inteins." *Protein Sci.* 2005; 14, 523-532; Schwartz, et al., "Post-translational enzyme activation in an animal via optimized conditional protein splicing." *Nat. Chem. Biol.* 2007; 3, 50-54; Peck et al., *Chem. Biol.* 2011; 18 (5), 619-630; the entire contents of each are hereby incorporated by reference. Exemplary sequences are as follows:

| NAME | SEQUENCE OF LIGAND-DEPENDENT INTEIN |
| --- | --- |
| 2-4 INTEIN: | CLAEGTRIFDPVTGTTHRIEDVVDGRKPIHVVAAAKDGTLLARPVV<br>SWFDQGTRDVIGLRIAGGAIVWATPDHKVLTEYGWRAAGELRKGD<br>RVAGPGGS GNSLALSLTADQMVSALLDAEPPILYSEYDPTSPFSEAS<br>MMGLLTNLADRELVHMINWAKRVPGFVDLTLHDQAHLLECAWLEI<br>LMIGLVWRSMEHPGKLLFAPNLLLDRNQGKCVEGMVEIFDMLLAT<br>SSRFRMMNLQGEEFVCLKSIILLNSGVYTFLSSTLKSLEEKDHIHRA<br>LDKITDTLIHLMAKAGLTLQQQHQRLAQLLLILSHIRHMSNKGMEH<br>LYSMKYKNVVPLYDLLLEMLDAHRLHAGGSGASRVQAFADALDD<br>KFLHDMLAEELRYSVIREVLPTRRARTFDLEVEELHTLVAEGVVVH<br>NC (SEQ ID NO: 8) |
| 3-2 INTEIN | CLAEGTRIFDPVTGTTHRIEDVVDGRKPIHVVAVAKDGTLLARPVVS<br>WFDQGTRDVIGLRIAGGAIVWATPDHKVLTEYGWRAAGELRKGDR<br>VAGPGGSGNSLALSLTADQMVSALLDAEPPILYSEYDPTSPFSEASM<br>MGLLTNLADRELVHMINWAKRVPGFVDLTLHDQAHLLECAWLEIL<br>MIGLVWRSMEHPGKLLFAPNLLLDRNQGKCVEGMVEIFDMLLATS<br>SRFRMMNLQGEEFVCLKSIILLNSGVYTFLSSTLKSLEEKDHIHRAL<br>DKITDTLIHLMAKAGLTLQQQHQRLAQLLLILSHIRHMSNKGMEHL<br>YSMKYTNVVPLYDLLLEMLDAHRLHAGGSGASRVQAFADALDDK<br>FLHDMLAEELRYSVIREVLPTRRARTFDLEVEELHTLVAEGVVVHN<br>C (SEQ ID NO: 9) |

-continued

| NAME | SEQUENCE OF LIGAND-DEPENDENT INTEIN |
|---|---|
| 30R3-1 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPIPYSEYDPTSPFSEA SMMGLLTNLADRELVHMINWAKRVPGFVDLTLHDQAHLLECAWL EILMIGLVWRSMEHPGKLLFAPNLLLDRNQGKCVEGMVEIFDMLL ATSSRFRMMNLQGEEFVCLKSIILLNSGVYTFLSSTLKSLEEKDHIH RALDKITDTLIHLMAKAGLTLQQQHQRLAQLLLILSHIRHMSNKGM EHLYSMKYKNVVPLYDLLLEMLDAHRLHAGGSGASRVQAFADAL DDKFLHDMLAEGLRYSVIREVLPTRRARTFDLEVEELHTLVAEGVV VHNC (SEQ ID NO: 10) |
| 30R3-2 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPIPYSEYDPTSPFSEA SMMGLLTNLADRELVHMINWAKRVPGFVDLTLHDQAHLLECAWL EILMIGLVWRSMEHPGKLLFAPNLLLDRNQGKCVEGMVEIFDMLL ATSSRFRMMNLQGEEFVCLKSIILLNSGVYTFLSSTLKSLEEKDHIH RALDKITDTLIHLMAKAGLTLQQQHQRLAQLLLILSHIRHMSNKGM EHLYSMKYKNVVPLYDLLLEMLDAHRLHAGGSGASRVQAFADAL DDKFLHDMLAEELRYSVIREVLPTRRARTFDLEVEELHTLVAEGVV VHNC (SEQ ID NO: 11) |
| 30R3-3 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPIPYSEYDPTSPFSEA SMMGLLTNLADRELVHMINWAKRVPGFVDLTLHDQAHLLECAWL EILMIGLVWRSMEHPGKLLFAPNLLLDRNQGKCVEGMVEIFDMLL ATSSRFRMMNLQGEEFVCLKSIILLNSGVYTFLSSTLKSLEEKDHIH RALDKITDTLIHLMAKAGLTLQQQHQRLAQLLLILSHIRHMSNKGM EHLYSMKYKNVVPLYDLLLEMLDAHRLHAGGSGASRVQAFADAL DDKFLHDMLAEELRYS VIREVLPTRRARTFDLEVEELHTLVAEGVV VHNC (SEQ ID NO: 12) |
| 37R3-1 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPILYSEYNPTSPFSEA SMMGLLTNLADRELVHMINWAKRVPGFVDLTLHDQAHLLERAWL EILMIGLVWRSMEHPGKLLFAPNLLLDRNQGKCVEGMVEIFDMLL ATSSRFRMMNLQGEEFVCLKSIILLNSGVYTFLSSTLKSLEEKDHIH RALDKITDTLIHLMAKAGLTLQQQHQRLAQLLLILSHIRHMSNKGM EHLYSMKYKNVVPLYDLLLEMLDAHRLHAGGSGASRVQAFADAL DDKFLHDMLAEGLRYSVIREVLPTRRARTFDLEVEELHTLVAEGVV VHNC((SEQ ID NO: 13) |
| 37R3-2 INTEIN | CLAEGTRIFDPVTGTTHRIEDVVDGRKPIHVVAAAKDGTLLARPVV SWFDQGTRDVIGLRIAGGAIVWATPDHKVLTEYGWRAAGELRKGD RVAGPGGSGNSLALSLTADQMVSALLDAEPPILYSEYDPTSPFSEAS MMGLLTNLADRELVHMINWAKRVPGFVDLTLHDQAHLLERAWLEI LMIGLVWRSMEHPGKLLFAPNLLLDRNQGKCVEGMVEIFDMLLAT SSRFRMMNLQGEEFVCLKSIILLNSGVYTFLSSTLKSLEEKDHIHRA LDKITDTLIHLMAKAGLTLQQQHQRLAQLLLILSHIRHMSNKGMEH LYSMKYKNVVPLYDLLLEMLDAHRLHAGGSGASRVQAFADALDD KFLHDMLAEGLRYSVIREVLPTRRARTFDLEVEELHTLVAEGVVVH NC (SEQ ID NO: 14) |
| 37R3-3 INTEIN | CLAEGTRIFDPVTGTTHRIEDVVDGRKPIHVVAVAKDGTLLARPVVS WFDQGTRDVIGLRIAGGATVWATPDHKVLTEYGWRAAGELRKGD RVAGPGGSGNSLALSLTADQMVSALLDAEPPILYSEYDPTSPFSEAS MMGLLTNLADRELVHMINWAKRVPGFVDLTLHDQAHLLERAWLEI LMIGLVWRSMEHPGKLLFAPNLLLDRNQGKCVEGMVEIFDMLLAT SSRFRMMNLQGEEFVCLKSIILLNSGVYTFLSSTLKSLEEKDHIHRA LDKITDTLIHLMAKAGLTLQQQHQRLAQLLLILSHIRHMSNKGMEH LYSMKYKNVVPLYDLLLEMLDAHRLHAGGSGASRVQAFADALDD KFLHDMLAEELRYSVIREVLPTRRARTFDLEVEELHTLVAEGVVVH NC (SEQ ID NO: 15) |

Linker

The term "linker," as used herein, refers to a molecule linking two other molecules or moieties. The linker can be an amino acid sequence in the case of a linker joining two fusion proteins. For example, a Cas9 can be fused to a reverse transcriptase by an amino acid linker sequence. The linker can also be a nucleotide sequence in the case of joining two nucleotide sequences together. For example, in the instant case, the traditional guide RNA is linked via a spacer or linker nucleotide sequence to the RNA extension of a prime editing guide RNA which may comprise a RT template sequence and an RT primer binding site. In other embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Isolated

"Isolated" means altered or removed from the natural state. For example, a nucleic 20 acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In some embodiments, a gene of interest is encoded by an isolated nucleic acid. As used herein, the term "isolated," refers to the characteristic of a material as provided herein being removed from its original or native environment (e.g., the natural environment if it is naturally occurring). Therefore, a naturally-occurring polynucleotide or protein or polypeptide present in a living animal is not isolated, but the same polynucleotide or polypeptide, separated by human intervention from some or all of the coexisting materials in the natural system, is isolated. An artificial or engineered material, for example, a non-naturally occurring nucleic acid construct, such as the expression constructs and vectors described herein, are, accordingly, also referred to as isolated. A material does not have to be purified in order to be isolated. Accordingly, a material may be part of a vector and/or part of a composition, and still be isolated in that such vector or composition is not part of the environment in which the material is found in nature.

MS2 Tagging Technique

In various embodiments (e.g., as depicted in the embodiments of FIGS. 72-73 and in Example 19), the term "MS2 tagging technique" refers to the combination of an "RNA-protein interaction domain" (aka "RNA-protein recruitment domain or protein") paired up with an RNA-binding protein that specifically recognizes and binds to the RNA-protein interaction domain, e.g., a specific hairpin structure. These types of systems can be leveraged to recruit a variety of functionalities to a prime editor complex that is bound to a target site. The MS2 tagging technique is based on the natural interaction of the MS2 bacteriophage coat protein ("MCP" or "MS2cp") with a stem-loop or hairpin structure present in the genome of the phage, i.e., the "MS2 hairpin." In the case of prime editing, the MS2 tagging technique comprises introducing the MS2 hairpin into a desired RNA molecule involved in prime editing (e.g., a PEgRNA or a tPERT), which then constitutes a specific interactable binding target for an RNA-binding protein that recognizes and binds to that structure. In the case of the MS2 hairpin, it is recognized and bound by the MS2 bacteriophage coat protein (MCP). And, if MCP is fused to another protein (e.g., a reverse transcriptase or other DNA polymerase), then the MS2 hairpin may be used to "recruit" that other protein in trans to the target site occupied by the prime editing complex.

The prime editors described herein may incorporate as an aspect any known RNA-protein interaction domain to recruit or "co-localize" specific functions of interest to a prime editor complex. A review of other modular RNA-protein interaction domains are described in the art, for example, in Johans son et al., "RNA recognition by the MS2 phage coat protein," *Sem Virol.*, 1997, Vol. 8(3): 176-185; Delebecque et al., "Organization of intracellular reactions with rationally designed RNA assemblies," *Science*, 2011, Vol. 333: 470-474; Mali et al., "Cas9 transcriptional activators for target specificity screening and paired nickases for cooperative genome engineering," *Nat. Biotechnol.*, 2013, Vol. 31: 833-838; and Zalatan et al., "Engineering complex synthetic transcriptional programs with CRISPR RNA scaffolds," *Cell*, 2015, Vol. 160: 339-350, each of which are incorporated herein by reference in their entireties. Other systems include the PP7 hairpin, which specifically recruits the PCP protein, and the "corn" hairpin, which specifically recruits the Com protein. See Zalatan et al.

The nucleotide sequence of the MS2 hairpin (or equivalently referred to as the "MS2 aptamer") is: GCCAACATGAGGATCACCCATGTCTGCAGGGCC (SEQ ID NO: 763).

The amino acid sequence of the MCP or MS2cp is:

```
                                        (SEQ ID NO: 764)
GSASNFTQFVLVDNGGTGDVTVAPSNFANGVAEWISSNSRSQAYKVTCSVR

QSSAQNRKYTIKVEVPKVATQTVGGEELPVAGWRSYLNMELTIPIFATNSD

CELIVKAMQGLLKDGNPIPSAIAANSGIY.
```

The MS2 hairpin (or "MS2 aptamer") may also be referred to as a type of "RNA effector recruitment domain" (or equivalently as "RNA-binding protein recruitment domain" or simply as "recruitment domain") since it is a physical structure (e.g., a hairpin) that is installed into a PEgRNA or tPERT that effectively recruits other effector functions (e.g., RNA-binding proteins having various functions, such as DNA polymerases or other DNA-modifying enzymes) to the PEgRNA or rPERT that is so modified, and thus, co-localizing effector functions in trans to the prime editing machinery. This application is not intended to be limited in any way to any particular RNA effector recruitment domains and may include any available such domain, including the MS2 hairpin. Example 19 and FIG. 72(*b*) depicts the use of the MS2 aptamer joined to a DNA synthesis domain (i.e., the tPERT molecule) and a prime editor that comprises an MS2cp protein fused to a PE2 to cause the co-localization of the prime editor complex (MS2cp-PE2:sgRNA complex) bound to the target DNA site and the DNA synthesis domain of the tPERT molecule.

napDNAbp

As used herein, the term "nucleic acid programmable DNA binding protein" or "napDNAbp," of which Cas9 is an example, refer to a proteins which use RNA:DNA hybridization to target and bind to specific sequences in a DNA molecule. Each napDNAbp is associated with at least one guide nucleic acid (e.g., guide RNA), which localizes the napDNAbp to a DNA sequence that comprises a DNA strand (i.e., a target strand) that is complementary to the guide nucleic acid, or a portion thereof (e.g., the protospacer of a guide RNA). In other words, the guide nucleic-acid "programs" the napDNAbp (e.g., Cas9 or equivalent) to localize and bind to a complementary sequence.

Without being bound by theory, the binding mechanism of a napDNAbp-guide RNA complex, in general, includes the step of forming an R-loop whereby the napDNAbp induces the unwinding of a double-strand DNA target, thereby separating the strands in the region bound by the napDNAbp. The guide RNA protospacer then hybridizes to the "target strand." This displaces a "non-target strand" that is complementary to the target strand, which forms the single strand region of the R-loop. In some embodiments, the napDNAbp includes one or more nuclease activities, which then cut the DNA leaving various types of lesions. For example, the napDNAbp may comprises a nuclease activity that cuts the non-target strand at a first location, and/or cuts the target strand at a second location. Depending on the nuclease activity, the target DNA can be cut to form a "double-stranded break" whereby both strands are cut. In other embodiments, the target DNA can be cut at only a single site, i.e., the DNA is "nicked" on one strand. Exemplary napDNAbp with different nuclease activities include "Cas9 nickase" ("nCas9") and a deactivated Cas9 having no nuclease activities ("dead Cas9" or "dCas9"). Exemplary sequences for these and other napDNAbp are provided herein.

Nickase

The term "nickase" refers to a Cas9 with one of the two nuclease domains inactivated. This enzyme is capable of cleaving only one strand of a target DNA.

Nuclear Localization Sequence (NLS)

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for its disclosure of exemplary nuclear localization sequences. In some embodiments, a NLS comprises the amino acid sequence PKKKRKV (SEQ ID NO: 16) or MDSLLMNRRKFLY-QFKNVRWAKGRRETYLC (SEQ ID NO: 17).

Nucleic Acid Molecule

The term "nucleic acid," as used herein, refers to a polymer of nucleotides. The polymer may include natural nucleosides (i.e., adenosine, thymidine, guano sine, cytidine, uridine, deoxyadenosine, deoxythymidine, deoxyguanosine, and deoxycytidine), nucleoside analogs (e.g., 2-aminoadenosine, 2-thiothymidine, inosine, pyrrolo-pyrimidine, 3-methyl adenosine, 5-methylcytidine, C5 bromouridine, C5 fluorouridine, C5 iodouridine, C5 propynyl uridine, C5 propynyl cytidine, C5 methylcytidine, 7 deazaadenosine, 7 deazaguanosine, 8 oxoadenosine, 8 oxoguanosine, O(6) methylguanine, 4-acetylcytidine, 5-(carboxyhydroxymethyl)uridine, dihydrouridine, methylpseudouridine, 1-methyl adenosine, 1-methyl guanosine, N6-methyl adenosine, and 2-thiocytidine), chemically modified bases, biologically modified bases (e.g., methylated bases), intercalated bases, modified sugars (e.g., 2'-fluororibose, ribose, 2'-deoxyribose, 2'-O-methylcytidine, arabinose, and hexose), or modified phosphate groups (e.g., phosphorothioates and 5' N phosphoramidite linkages).

PEgRNA

As used herein, the terms "prime editing guide RNA" or "PEgRNA" or "extended guide RNA" refers to a specialized form of a guide RNA that has been modified to include one or more additional sequences for implementing the prime editing methods and compositions described herein. As described herein, the prime editing guide RNA comprise one or more "extended regions" of nucleic acid sequence. The extended regions may comprise, but are not limited to, single-stranded RNA or DNA. Further, the extended regions may occur at the 3' end of a traditional guide RNA. In other arrangements, the extended regions may occur at the 5' end of a traditional guide RNA. In still other arrangements, the extended region may occur at an intramolecular region of the traditional guide RNA, for example, in the gRNA core region which associates and/or binds to the napDNAbp. The extended region comprises a "DNA synthesis template" which encodes (by the polymerase of the prime editor) a single-stranded DNA which, in turn, has been designed to be (a) homologous with the endogenous target DNA to be edited, and (b) which comprises at least one desired nucleotide change (e.g., a transition, a transversion, a deletion, or an insertion) to be introduced or integrated into the endogenous target DNA. The extended region may also comprise other functional sequence elements, such as, but not limited to, a "primer binding site" and a "spacer or linker" sequence, or other structural elements, such as, but not limited to aptamers, stem loops, hairpins, toe loops (e.g., a 3' toeloop), or an RNA-protein recruitment domain (e.g., MS2 hairpin). As used herein the "primer binding site" comprises a sequence that hybridizes to a single-strand DNA sequence having a 3' end generated from the nicked DNA of the R-loop.

In certain embodiments, the PEgRNAs are represented by FIG. 3A, which shows a PEgRNA having a 5' extension arm, a spacer, and a gRNA core. The 5' extension further comprises in the 5' to 3' direction a reverse transcriptase template, a primer binding site, and a linker. As shown, the reverse transcriptase template may also be referred to more broadly as the "DNA synthesis template" where the polymerase of a prime editor described herein is not an RT, but another type of polymerase.

In certain other embodiments, the PEgRNAs are represented by FIG. 3B, which shows a PEgRNA having a 5' extension arm, a spacer, and a gRNA core. The 5' extension further comprises in the 5' to 3' direction a reverse transcriptase template, a primer binding site, and a linker. As shown, the reverse transcriptase template may also be referred to more broadly as the "DNA synthesis template" where the polymerase of a prime editor described herein is not an RT, but another type of polymerase.

In still other embodiments, the PEgRNAs are represented by FIG. 3D, which shows a PEgRNA having in the 5' to 3' direction a spacer (1), a gRNA core (2), and an extension arm (3). The extension arm (3) is at the 3' end of the PEgRNA. The extension arm (3) further comprises in the 5' to 3' direction a "primer binding site" (A), an "edit template" (B), and a "homology arm" (C). The extension arm (3) may also comprise an optional modifier region at the 3' and 5' ends, which may be the same sequences or different sequences. In addition, the 3' end of the PEgRNA may comprise a transcriptional terminator sequence. These sequence elements of the PEgRNAs are further described and defined herein.

In still other embodiments, the PEgRNAs are represented by FIG. 3E, which shows a PEgRNA having in the 5' to 3' direction an extension arm (3), a spacer (1), and a gRNA core (2). The extension arm (3) is at the 5' end of the PEgRNA. The extension arm (3) further comprises in the 3' to 5' direction a "primer binding site" (A), an "edit template" (B), and a "homology arm" (C). The extension arm (3) may also comprise an optional modifier region at the 3' and 5' ends, which may be the same sequences or different sequences. The PEgRNAs may also comprise a transcriptional terminator sequence at the 3' end. These sequence elements of the PEgRNAs are further described and defined herein.

PE1

As used herein, "PE1" refers to a PE complex comprising a fusion protein comprising Cas9(H840A) and a wild type MMLV RT having the following structure: [NLS]-[Cas9 (H840A)]-[linker]-[MMLV_RT(wt)]+a desired PEgRNA, wherein the PE fusion has the amino acid sequence of SEQ ID NO: 123, which is shown as follows;

(SEQ ID NO: 123)
MKRTADGSEFESPKKKRKVDKKYSIGLDIGTNSVGWAVITDEYKVPSKKFK

VLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGL

FGNLIALSLGLTPNFKSNFDLAEDAKLQLSKDTYDDDLDNLLAQIGDQYAD

LFLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKIE

KILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGE

QKKAIVDLLFKTNRKVTVKQLKEDYFKKIECFDSVEISGVEDRFNASLGTY

HDLLKIIKDKDFLDNEENEDILEDIVLTLTLFEDREMIEERLKTYAHLFDD

KVMKQLKRRRYTGWGRLSRKLINGIRDKQSGKTILDFLKSDGFANRNFMQL

IHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKE

HPVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLIR

EVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLA

NGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSK

KLKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQL

FVEQHKHYLDEIIEQISEFSKRVILADANLDKVLSAYNKHRDKPIREQAEN

IIHLFTLTNLGAPAAFKYFDTTIDRKRYTSTKEVLDATLIHQSITGLYETR

IDLSQLGGD*SGGSSGGSSGSETPGTSESATPESSGGSSGGSS*TLNIEDEYR

*LHETSKEPDVSLGSTWLSDFPQAWAETGGMGLAVRQAPLIIPLKATSTPVS*

*IKQYPMSQEARLGIKPHIQRLLDQGILVPCQSPWNTPLLPVKKPGTNDYRP*

*VQDLREVNKRVEDIHPTVPNPYNLLSGLPPSHQWYTVLDLKDAFFCLRLHP*

*TSQPLFAFEWRDPEMGISGQLTWTRLPQGFKNSPTLFDEALHRDLADFRIQ*

*HPDLILLQYVDDLLLAATSELDCQQGTRALLQTLGNLGYRASAKKAQICQK*

*QVKYLGYLLKEGQRWLTEARKETVMGQPTPKTPRQLREFLGTAGFCRLWIP*

*GFAEMAAPLYPLTKTGTLFNWGPDQQKAYQEIKQALLTAPALGLPDLTKPF*

*ELFVDEKQGYAKGVLTQKLGPWRRPVAYLSKKLDPVAAGWPPCLRMVAAIA*

*VLTKDAGKLTMGQPLVILAPHAVEALVKQPPDRWLSNARMTHYQALLLDTD*

*RVQFGPVVALNPATLLPLPEEGLQHNCLDILAEAHGTRPDLTDQPLPDADH*

*TWYTDGSSLLQEGQRKAGAAVTTETEVIWAKALPAGTSAQRAELIALTQAL*

*KMAEGKKLNVYTDSRYAFATAHIHGEIYRRRGLLTSEGKEIKNKDEILALL*

-continued
*KALFLPKRLSIIHCPGHQKGHSAEARGNRMADQAARKAAITETPDTSTLLL*

*IENSSP*SGGSKRTADGSEFEPKKKRKV

KEY:

NUCLEAR LOCALIZATION SEQUENCE (NLS)
TOP: (SEQ ID NO: 124), BOTTOM: (SEQ ID NO: 133)
CAS9(H840A) (SEQ ID NO: 126)

33-AMINO ACID LINKER (SEP ID NO: 127)
M-MLV reverse transcriptase (SEQ ID NO: 128).

PE2

As used herein, "PE2" refers to a PE complex comprising a fusion protein comprising Cas9(H840A) and a variant MMLV RT having the following structure: [NLS]-[Cas9 (H840A)]-[linker]-[MMLV_RT(D200N)(T330P)(L603W) (T306K)(W313F)]+a desired PEgRNA, wherein the PE fusion has the amino acid sequence of SEQ ID NO: 134, which is shown as follows:

(SEQ ID NO: 134)
MKRTADGSEFESPKKKRKVDKKYSIGLDIGTNSVGWAVITDEYKVPSKKFK

VLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGL

FGNLIALSLGLTPNFKSNFDLAEDAKLQLSKDTYDDDLDNLLAQIGDQYAD

LFLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKIE

KILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGE

QKKAIVDLLFKTNRKVTVKQLKEDYFKKIECFDSVEISGVEDRFNASLGTY

HDLLKIIKDKDFLDNEENEDILEDIVLTLTLFEDREMIEERLKTYAHLFDD

KVMKQLKRRRYTGWGRLSRKLINGIRDKQSGKTILDFLKSDGFANRNFMQL

IHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKE

HPVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLIR

EVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLA

NGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSK

KLKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQL

FVEQHKHYLDEIIEQISEFSKRVILADANLDKVLSAYNKHRDKPIREQAEN

IIHLFTLTNLGAPAAFKYFDTTIDRKRYTSTKEVLDATLIHQSITGLYETR

IDLSQLGGDSGGSSGGSSGSETPGTSESATPESSGGSSGGSSTLNIEDEYR

*LHETSKEPDVSLGSTWLSDFPQAWAETGGMGLAVRQAPLIIPLKATSTPVS*

```
IKQYPMSQEARLGIKPHIQRLLDQGILVPCQSPWNTPLLPVKKPGTNDYRP

VQDLREVNKRVEDIHPTVPNPYNLLSGLPPSHQWYTVLDLKDAFFCLRLHP

TSQPLFAFEWRDPEMGISGQLTWTRLPQGFKNSPTLFNEALHRDLADFRIQ

HPDLILLQYVDDLLLAATSELDCQQGTRALLQTLGNLGYRASAKKAQICQK

QVKYLGYLLKEGQRWLTEARKETVMGQPTPKTPRQLREFLGKAGFCRLFIP

GFAEMAAPLYPLTKPGTLFNWGPDQQKAYQEIKQALLTAPALGLPDLTKPF

ELFVDEKQGYAKGVLTQKLGPWRRPVAYLSKKLDPVAAGWPPCLRMVAAIA

VLTKDAGKLTMGQPLVILAPHAVEALVKQPPDRWLSNARMTHYQALLLDTD

RVQFGPVVALNPATLLPLPEEGLQHNCLDILAEAHGTRPDLTDQPLPDADH

TWYTDGSSLLQEGQRKAGAAVTTETEVIWAKALPAGTSAQRAELIALTQAL

KMAEGKKLNVYTDSRYAFATAHIHGEIYRRRGWLTSEGKEIKNKDEILALL

KALFLPKRLSIIHCPGHQKGHSAEARGNRMADQAARKAAITETPDTSTLLI

ENSSPSGGSKRTADGSEFEPKKKRKV
```
KEY:
<u>NUCLEAR LOCALIZATION SEQUENCE (NLS)</u>
TOP: (SEQ ID NO: 124), BOTTOM: (SEQ ID NO: 133)
CAS9(H840A) (SEQ ID NO: 137)
<u>33-AMINO ACID LINKER</u> (SEP ID NO: 127)
M-MLV reverse transcriptase (SEQ ID NO: 139).

PE3

As used herein, "PE3" refers to PE2 plus a second-strand nicking guide RNA that complexes with the PE2 and introduces a nick in the non-edited DNA strand in order to induce preferential replacement of the edited strand.

PE3b

As used herein, "PE3b" refers to PE3 but wherein the second-strand nicking guide RNA is designed for temporal control such that the second strand nick is not introduced until after the installation of the desired edit. This is achieved by designing a gRNA with a spacer sequence that matches only the edited strand, but not the original allele. Using this strategy, referred to hereafter as PE3b, mismatches between the protospacer and the unedited allele should disfavor nicking by the sgRNA until after the editing event on the PAM strand takes place.

PE-Short

As used herein, "PE-short" refers to a PE construct that is fused to a C-terminally truncated reverse transcriptase, and has the following amino acid sequence:

(SEQ ID NO: 765)
```
MKRTADGSEFESPKKKRKVDKKYSIGLDIGTNSVGWAVITDEYKVPSKKFK

VLGNTDRHSIKKNLIGALLFDSGETAEATRLKRTARRRYTRRKNRICYLQE

IFSNEMAKVDDSFFHRLEESFLVEEDKKHERHPIFGNIVDEVAYHEKYPTI

YHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGL

FGNLIALSLGLTPNFKSNFDLAEDAKLQLSKDTYDDDLDNLLAQIGDQYAD

LFLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKIE

KILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGE

QKKAIVDLLFKTNRKVTVKQLKEDYFKKIECFDSVEISGVEDRFNASLGTY

HDLLKIIKDKDFLDNEENEDILEDIVLTLTLFEDREMIEERLKTYAHLFDD

KVMKQLKRRRYTGWGRLSRKLINGIRDKQSGKTILDFLKSDGFANRNFMQL

IHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKE

HPVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLIR

EVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLA

NGEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKSK

KLKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQL

FVEQHKHYLDEIIEQISEFSKRVILADANLDKVLSAYNKHRDKPIREQAEN

IIHLFTLTNLGAPAAFKYFDTTIDRKRYTSTKEVLDATLIHQSITGLYETR

IDLSQLGGDSGGSSGGSSGSETPGTSESATPESSGGSSGGSSTLNIEDEYR

LHETSKEPDVSLGSTWLSDFPQAWAETGGMGLAVRQAPLIIPLKATSTPVS

IKQYPMSQEARLGIKPHIQRLLDQGILVPCQSPWNTPLLPVKKPGTNDYRP

VQDLREVNKRVEDIHPTVPNPYNLLSGLPPSHQWYTVLDLKDAFFCLRLHP

TSQPLFAFEWRDPEMGISGQLTWTRLPQGFKNSPTLFNEALHRDLADFRIQ

HPDLILLQYVDDLLLAATSELDCQQGTRALLQTLGNLGYRASAKKAQICQK

QVKYLGYLLKEGQRWLTEARKETVMGQPTPKTPRQLREFLGKAGFCRLFIP

GFAEMAAPLYPLTKPGTLFNWGPDQQKAYQEIKQALLTAPALGLPDLTKPF

ELFVDEKQGYAKGVLTQKLGPWRRPVAYLSKKLDPVAAGWPPCLRMVAAIA

VLTKDAGKLTMGQPLVILAPHAVEALVKQPPDRWLSNARMTHYQALLLDTD

RVQFGPVVALNPATLLPLPEEGLQHNCLDNSRLINSGGSKRTADGSEFEPK

KKRKV
```
KEY:
<u>NUCLEAR LOCALIZATION SEQUENCE (NLS)</u>
TOP: (SEQ ID NO: 124), BOTTOM: (SEQ ID NO: 133)
CAS9(H840A) (SEQ ID NO: 157)
<u>33-AMINO ACID LINKER 1</u> (SEP ID NO: 127)
M-MLV TRUNCATED REVERSE TRANSCRIPTASE (SEQ ID NO: 766).

The term "peptide tag" refers to a peptide amino acid sequence that is genetically fused to a protein sequence to impart one or more functions onto the proteins that facilitate the manipulation of the protein for various purposes, such as, visualization, purification, solubilization, and separation, etc. Peptide tags can include various types of tags categorized by purpose or function, which may include "affinity tags" (to facilitate protein purification), "solubilization tags" (to assist in proper folding of proteins), "chromatography tags" (to alter chromatographic properties of proteins), "epitope tags" (to bind to high affinity antibodies), "fluorescence tags" (to facilitate visualization of proteins in a cell or in vitro).

Polymerase

As used herein, the term "polymerase" refers to an enzyme that synthesizes a nucleotide strand and which may be used in connection with the prime editor systems described herein. The polymerase can be a "template-dependent" polymerase (i.e., a polymerase which synthesizes a nucleotide strand based on the order of nucleotide bases of a template strand). The polymerase can also be a "template-independent" polymerase (i.e., a polymerase which synthesizes a nucleotide strand without the requirement of a template strand). A polymerase may also be further categorized as a "DNA polymerase" or an "RNA polymerase." In various embodiments, the prime editor system comprises a DNA polymerase. In various embodiments, the DNA polymerase can be a "DNA-dependent DNA polymerase" (i.e., whereby the template molecule is a strand of DNA). In such cases, the DNA template molecule can be a PEgRNA, wherein the extension arm comprises a strand of DNA. In such cases, the PEgRNA may be referred to as a chimeric or hybrid PEgRNA which comprises an RNA portion (i.e., the guide RNA components, including the spacer and the gRNA core) and a DNA portion (i.e., the extension arm). In various other embodiments, the DNA polymerase can be an "RNA-dependent DNA polymerase" (i.e., whereby the template molecule is a strand of RNA). In such cases, the PEgRNA is RNA, i.e., including an RNA extension. The term "polymerase" may also refer to an enzyme that catalyzes the polymerization of nucleotide (i.e., the polymerase activity). Generally, the enzyme will initiate synthesis at the 3'-end of a primer annealed to a polynucleotide template sequence (e.g., such as a primer sequence annealed to the primer binding site of a PEgRNA), and will proceed toward the 5' end of the template strand. A "DNA polymerase" catalyzes the polymerization of deoxynucleotides. As used herein in reference to a DNA polymerase, the term DNA polymerase includes a "functional fragment thereof". A "functional fragment thereof" refers to any portion of a wild-type or mutant DNA polymerase that encompasses less than the entire amino acid sequence of the polymerase and which retains the ability, under at least one set of conditions, to catalyze the polymerization of a polynucleotide. Such a functional fragment may exist as a separate entity, or it may be a constituent of a larger polypeptide, such as a fusion protein.

Prime Editing

As used herein, the term "prime editing" refers to a novel approach for gene editing using napDNAbps, a polymerase (e.g., a reverse transcriptase), and specialized guide RNAs that include a DNA synthesis template for encoding desired new genetic information (or deleting genetic information) that is then incorporated into a target DNA sequence. Certain embodiments of prime editing are described in the embodiments of FIGS. 1A-1H and FIG. 72(a)-72(c), among other figures.

Prime editing represents an entirely new platform for genome editing that is a versatile and precise genome editing method that directly writes new genetic information into a specified DNA site using a nucleic acid programmable DNA binding protein ("napDNAbp") working in association with a polymerase (i.e., in the form of a fusion protein or otherwise provided in trans with the napDNAbp), wherein the prime editing system is programmed with a prime editing (PE) guide RNA ("PEgRNA") that both specifies the target site and templates the synthesis of the desired edit in the form of a replacement DNA strand by way of an extension (either DNA or RNA) engineered onto a guide RNA (e.g., at the 5' or 3' end, or at an internal portion of a guide RNA). The replacement strand containing the desired edit (e.g., a single nucleobase substitution) shares the same (or is homologous to) sequence as the endogenous strand (immediately downstream of the nick site) of the target site to be edited (with the exception that it includes the desired edit). Through DNA repair and/or replication machinery, the endogenous strand downstream of the nick site is replaced by the newly synthesized replacement strand containing the desired edit. In some cases, prime editing may be thought of as a "search-and-replace" genome editing technology since the prime editors, as described herein, not only search and locate the desired target site to be edited, but at the same time, encode a replacement strand containing a desired edit which is installed in place of the corresponding target site endogenous DNA strand. The prime editors of the present disclosure relate, in part, to the discovery that the mechanism of target-primed reverse transcription (TPRT) or "prime editing" can be leveraged or adapted for conducting precision CRISPR/Cas-based genome editing with high efficiency and genetic flexibility (e.g., as depicted in various embodiments of FIGS. 1A-1F). TPRT is naturally used by mobile DNA elements, such as mammalian non-LTR retrotransposons and bacterial Group II introns[28,29]. The inventors have herein used Cas protein-reverse transcriptase fusions or related systems to target a specific DNA sequence with a guide RNA, generate a single strand nick at the target site, and use the nicked DNA as a primer for reverse transcription of an engineered reverse transcriptase template that is integrated with the guide RNA. However, while the concept begins with prime editors that use reverse transcriptase as the DNA polymerase component, the prime editors described herein are not limited to reverse transcriptases but may include the use of virtually any DNA polymerase. Indeed, while the application throughout may refer to prime editors with "reverse transcriptases," it is set forth here that reverse transcriptases are only one type of DNA polymerase that may work with prime editing. Thus, where ever the specification mentions a "reverse transcriptase," the person having ordinary skill in the art should appreciate that any suitable DNA polymerase may be used in place of the reverse transcriptase. Thus, in one aspect, the prime editors may comprise Cas9 (or an equivalent napDNAbp) which is programmed to target a DNA sequence by associating it with a specialized guide RNA (i.e., PEgRNA) containing a spacer sequence that anneals to a complementary protospacer in the target DNA. The specialized guide RNA also contains new genetic information in the form of an extension that encodes a replacement strand of DNA containing a desired genetic alteration which is used to replace a corresponding endogenous DNA strand at the target site. To transfer information from the PEgRNA to the target DNA, the mechanism of prime editing involves nicking the target site in one strand of the DNA to expose a 3'-hydroxyl group. The exposed 3'-hydroxyl group can then be used to prime the DNA polymerization of the edit-encoding extension on PEgRNA directly into the target site. In various embodiments, the extension—which provides the template for polymerization of the replacement strand containing the edit—can be formed from RNA or DNA. In the case of an RNA extension, the polymerase of the prime editor can be an RNA-dependent DNA polymerase (such as, a reverse transcriptase). In the case of a DNA extension, the polymerase of the prime editor may be a DNA-dependent DNA polymerase. The newly synthesized strand (i.e., the replacement DNA strand containing the desired edit) that is formed by the herein disclosed prime editors would be homologous to the genomic target sequence (i.e., have the same sequence as) except for the inclusion of a desired nucleotide change (e.g., a single nucleotide change, a deletion, or an insertion, or a combination thereof). The newly synthesized (or replacement) strand of DNA may also be referred to as a single strand DNA flap, which would compete for hybridization with the complementary homologous endogenous DNA strand, thereby displacing the corresponding endogenous strand. In certain embodiments, the system can be combined with the use of an error-prone reverse transcriptase enzyme (e.g., provided as a fusion protein with the Cas9 domain, or provided in trans to the Cas9 domain). The error-prone reverse transcriptase enzyme can introduce alterations during synthesis of the single strand DNA flap. Thus, in certain embodiments, error-prone reverse transcriptase can be utilized to introduce nucleotide changes to the target DNA. Depending on the error-prone reverse transcriptase that is used with the system, the changes can be random or non-random. Resolution of the hybridized intermediate (comprising the single strand DNA flap synthesized by the reverse transcriptase hybridized to the endogenous DNA strand) can include removal of the resulting displaced flap of endogenous DNA (e.g., with a 5' end DNA flap endonuclease, FEN1), ligation of the synthesized single strand DNA flap to the target DNA, and assimilation of the desired nucleotide change as a result of cellular DNA repair and/or replication processes. Because templated DNA synthesis offers single nucleotide precision for the modification of any nucleotide, including insertions and deletions, the scope of this approach is very broad and could foreseeably be used for myriad applications in basic science and therapeutics.

In various embodiments, prime editing operates by contacting a target DNA molecule (for which a change in the nucleotide sequence is desired to be introduced) with a nucleic acid programmable DNA binding protein (napDNAbp) complexed with a prime editing guide RNA (PEgRNA). In reference to FIG. 1G, the prime editing guide RNA (PEgRNA) comprises an extension at the 3' or 5' end of the guide RNA, or at an intramolecular location in the guide RNA and encodes the desired nucleotide change (e.g., single nucleotide change, insertion, or deletion). In step (a), the napDNAbp/extended gRNA complex contacts the DNA molecule and the extended gRNA guides the napDNAbp to bind to a target locus. In step (b), a nick in one of the strands of DNA of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence, i.e., the "non-target strand." The nick, however, could be introduced in either of the strands. That is, the nick could be introduced into the R-loop "target strand" (i.e., the strand hybridized to the protospacer of the extended gRNA) or the "non-target strand" (i.e., the strand forming the single-stranded portion of the R-loop and which is complementary to the target strand). In step (c), the 3' end of the DNA strand (formed by the nick) interacts with the extended portion of the guide RNA in order to prime reverse transcription (i.e., "target-primed RT"). In certain embodiments, the 3' end DNA strand hybridizes to a specific RT priming sequence on the extended portion of the guide RNA, i.e., the "reverse transcriptase priming sequence" or "primer binding site" on the PEgRNA. In step (d), a reverse transcriptase (or other suitable DNA polymerase) is introduced which synthesizes a single strand of DNA from the 3' end of the primed site towards the 5' end of the prime editing guide RNA. The DNA polymerase (e.g., reverse transcriptase) can be fused to the napDNAbp or alternatively can be provided in trans to the napDNAbp. This forms a single-strand DNA flap comprising the desired nucleotide change (e.g., the single base change, insertion, or deletion, or a combination thereof) and which is otherwise homologous to the endogenous DNA at or adjacent to the nick site. In step (e), the napDNAbp and guide RNA are released. Steps (f) and (g) relate to the resolution of the single strand DNA flap such that the desired nucleotide change becomes incorporated into the target locus. This process can be driven towards the desired product formation by removing the corresponding 5' endogenous DNA flap that forms once the 3' single strand DNA flap invades and hybridizes to the endogenous DNA sequence. Without being bound by theory, the cells endogenous DNA repair and replication processes resolves the mismatched DNA to incorporate the nucleotide change(s) to form the desired altered product. The process can also be driven towards product formation with "second strand nicking," as exemplified in FIG. 1F. This process may introduce at least one or more of the following genetic changes: transversions, transitions, deletions, and insertions.

The term "prime editor (PE) system" or "prime editor (PE)" or "PE system" or "PE editing system" refers the compositions involved in the method of genome editing using target-primed reverse transcription (TPRT) describe herein, including, but not limited to the napDNAbps, reverse transcriptases, fusion proteins (e.g., comprising napDNAbps and reverse transcriptases), prime editing guide RNAs, and complexes comprising fusion proteins and prime editing guide RNAs, as well as accessory elements, such as second strand nicking components (e.g., second strand sgRNAs) and 5' endogenous DNA flap removal endonucleases (e.g., FEN1) for helping to drive the prime editing process towards the edited product formation.

Although in the embodiments described thus far the PEgRNA constitutes a single molecule comprising a guide RNA (which itself comprises a spacer sequence and a gRNA core or scaffold) and a 5' or 3' extension arm comprising the primer binding site and a DNA synthesis template (e.g., see FIG. 3D, the PEgRNA may also take the form of two individual molecules comprised of a guide RNA and a trans prime editor RNA template (tPERT), which essentially houses the extension arm (including, in particular, the primer binding site and the DNA synthesis domain) and an RNA-protein recruitment domain (e.g., MS2 aptamer or hairpin) in the same molecule which becomes co-localized or recruited to a modified prime editor complex that comprises a tPERT recruiting protein (e.g., MS2cp protein, which binds to the MS2 aptamer). See FIG. 3G and FIG. 3H as an example of a tPERT that may be used with prime editing.

Prime Editor

The term "prime editor" refers to the herein described fusion constructs comprising a napDNAbp (e.g., Cas9 nickase) and a reverse transcriptase and is capable of carrying out prime editing on a target nucleotide sequence in the presence of a PEgRNA (or "extended guide RNA"). The term "prime editor" may refer to the fusion protein or to the fusion protein complexed with a PEgRNA, and/or further complexed with a second-strand nicking sgRNA. In some embodiments, the prime editor may also refer to the complex comprising a fusion protein (reverse transcriptase fused to a napDNAbp), a PEgRNA, and a regular guide RNA capable of directing the second-site nicking step of the non-edited strand as described herein. In other embodiments, the reverse transcriptase component of the "primer editor" may be provided in trans.

Primer Binding Site

The term "primer binding site" or "the PBS" refers to the nucleotide sequence located on a PEgRNA as component of the extension arm (typically at the 3' end of the extension arm) and serves to bind to the primer sequence that is formed after Cas9 nicking of the target sequence by the prime editor. As detailed elsewhere, when the Cas9 nickase component of a prime editor nicks one strand of the target DNA sequence, a 3'-ended ssDNA flap is formed, which serves a primer sequence that anneals to the primer binding site on the PEgRNA to prime reverse transcription. FIGS. 27 and 28 show embodiments of the primer binding site located on a 3' and 5' extension arm, respectively.

Promoter

The term "promoter" is art-recognized and refers to a nucleic acid molecule with a sequence recognized by the cellular transcription machinery and able to initiate transcription of a downstream gene. A promoter can be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. A subclass of conditionally active promoters are inducible promoters that require the presence of a small molecule "inducer" for activity. Examples of inducible promoters include, but are not limited to, arabinose-inducible promoters, Tet-on promoters, and tamoxifen-inducible promoters. A variety of constitutive, conditional, and inducible promoters are well known to the skilled artisan, and the skilled artisan will be able to ascertain a variety of such promoters useful in carrying out the instant invention, which is not limited in this respect.

Protospacer

As used herein, the term "protospacer" refers to the sequence (~20 bp) in DNA adjacent to the PAM (protospacer adjacent motif) sequence. The protospacer shares the same sequence as the spacer sequence of the guide RNA. The guide RNA anneals to the complement of the protospacer sequence on the target DNA (specifically, one strand thereof, i.e., the "target strand" versus the "non-target strand" of the target DNA sequence). In order for Cas9 to function it also requires a specific protospacer adjacent motif (PAM) that varies depending on the bacterial species of the Cas9 gene. The most commonly used Cas9 nuclease, derived from *S. pyogenes*, recognizes a PAM sequence of NGG that is found directly downstream of the target sequence in the genomic DNA, on the non-target strand. The skilled person will appreciate that the literature in the state of the art sometimes refers to the "protospacer" as the ~20-nt target-specific guide sequence on the guide RNA itself, rather than referring to it as a "spacer." Thus, in some cases, the term "protospacer" as used herein may be used interchangeably with the term "spacer." The context of the description surrounding the appearance of either "protospacer" or "spacer" will help inform the reader as to whether the term is in reference to the gRNA or the DNA target.

Protospacer Adjacent Motif (PAM)

As used herein, the term "protospacer adjacent sequence" or "PAM" refers to an approximately 2-6 base pair DNA sequence that is an important targeting component of a Cas9 nuclease. Typically, the PAM sequence is on either strand, and is downstream in the 5' to 3' direction of Cas9 cut site. The canonical PAM sequence (i.e., the PAM sequence that is associated with the Cas9 nuclease of *Streptococcus pyogenes* or SpCas9) is 5'-NGG-3' wherein "N" is any nucleobase followed by two guanine ("G") nucleobases. Different PAM sequences can be associated with different Cas9 nucleases or equivalent proteins from different organisms. In addition, any given Cas9 nuclease, e.g., SpCas9, may be modified to alter the PAM specificity of the nuclease such that the nuclease recognizes alternative PAM sequence.

For example, with reference to the canonical SpCas9 amino acid sequence is SEQ ID NO: 18, the PAM sequence can be modified by introducing one or more mutations, including (a) D1135V, R1335Q, and T1337R "the VQR variant", which alters the PAM specificity to NGAN or NGNG, (b) D1135E, R1335Q, and T1337R "the EQR variant", which alters the PAM specificity to NGAG, and (c) D1135V, G1218R, R1335E, and T1337R "the VRER variant", which alters the PAM specificity to NGCG. In addition, the D1135E variant of canonical SpCas9 still recognizes NGG, but it is more selective compared to the wild type SpCas9 protein.

It will also be appreciated that Cas9 enzymes from different bacterial species (i.e., Cas9 orthologs) can have varying PAM specificities. For example, Cas9 from *Staphylococcus aureus* (SaCas9) recognizes NGRRT or NGRRN. In addition, Cas9 from *Neisseria meningitis* (NmCas) recognizes NNNNGATT. In another example, Cas9 from *Streptococcus thermophilis* (StCas9) recognizes NNAGAAW. In still another example, Cas9 from *Treponema denticola* (TdCas) recognizes NAAAAC. These are example are not meant to be limiting. It will be further appreciated that non-SpCas9s bind a variety of PAM sequences, which makes them useful when no suitable SpCas9 PAM sequence is present at the desired target cut site. Furthermore, non-SpCas9s may have other characteristics that make them more useful than SpCas9. For example, Cas9 from *Staphylococcus aureus* (SaCas9) is about 1 kilobase smaller than SpCas9, so it can be packaged into adeno-associated virus (AAV). Further reference may be made to Shah et al., "Protospacer recognition motifs: mixed identities and functional diversity," RNA Biology, 10(5): 891-899 (which is incorporated herein by reference).

Recombinase

The term "recombinase," as used herein, refers to a site-specific enzyme that mediates the recombination of DNA between recombinase recognition sequences, which results in the excision, integration, inversion, or exchange (e.g., translocation) of DNA fragments between the recombinase recognition sequences. Recombinases can be classified into two distinct families: serine recombinases (e.g., resolvases and invertases) and tyrosine recombinases (e.g., integrases). Examples of serine recombinases include, without limitation, Hin, Gin, Tn3, β-six, CinH, ParA, γδ, Bxb1, φC31, TP901, TG1, φBT1, R4, φRV1, φFC1, MR11, A118, U153, and gp29. Examples of tyrosine recombinases include, without limitation, Cre, FLP, R, Lambda, HK101, HK022, and pSAM2. The serine and tyrosine recombinase names stem from the conserved nucleophilic amino acid residue that the recombinase uses to attack the DNA and which becomes covalently linked to the DNA during strand exchange. Recombinases have numerous applications, including the creation of gene knockouts/knock-ins and gene therapy applications. See, e.g., Brown et al., "Serine recombinases as tools for genome engineering." *Methods.* 2011; 53(4):372-9; Hirano et al., "Site-specific recombinases as tools for heterologous gene integration." *Appl. Microbiol. Biotechnol.* 2011; 92(2):227-39; Chavez and Calos, "Therapeutic applications of the ΦC31 integrase system." *Curr. Gene Ther.* 2011; 11(5):375-81; Turan and Bode, "Sitespecific recombinases: from tag-and-target-to tag-and-exchange-based genomic modifications." *FASEB J.* 2011; 25(12):4088-107; Venken and Bellen, "Genome-wide manipulations of *Drosophila melanogaster* with transposons, Flp recombinase, and ΦC31 integrase." *Methods Mol. Biol.* 2012; 859:203-28; Murphy, "Phage recombinases and their applications." *Adv. Virus Res.* 2012; 83:367-414; Zhang et al., "Conditional gene manipulation: Cre-ating a new biological era." *J. Zhejiang Univ. Sci. B.* 2012; 13(7):511-24; Karpenshif and Bernstein, "From yeast to mammals: recent advances in genetic control of homologous recombination." *DNA Repair (Amst).* 2012; 1; 11(10):781-8; the entire contents of each are hereby incorporated by reference in their entirety. The recombinases provided herein are not meant to be exclusive examples of recombinases that can be used in embodiments of the invention. The methods and compositions of the invention can be expanded by mining databases for new orthogonal recombinases or designing synthetic recombinases with defined DNA specificities (See, e.g., Groth et al., "Phage integrases: biology and applications." *J. Mol. Biol.* 2004; 335, 667-678; Gordley et al., "Synthesis of programmable integrases." *Proc. Natl. Acad. Sci. USA.* 2009; 106, 5053-5058; the entire contents of each are hereby incorporated by reference in their entirety). Other examples of recombinases that are useful in the methods and compositions described herein are known to those of skill in the art, and any new recombinase that is discovered or generated is expected to be able to be used in the different embodiments of the invention. In some embodiments, the catalytic domains of a recombinase are fused to a nuclease-inactivated RNA-programmable nuclease (e.g., dCas9, or a fragment thereof), such that the recombinase domain does not comprise a nucleic acid binding domain or is unable to bind to a target nucleic acid (e.g., the recombinase domain is engineered such that it does not have specific DNA binding activity). Recombinases lacking DNA binding activity and methods for engineering such are known, and include those described by Klippel et al., "Isolation and characterisation of unusual gin mutants." *EMBO J.* 1988; 7: 3983-3989: Burke et al., "Activating mutations of Tn3 resolvase marking interfaces important in recombination catalysis and its regulation. *Mol Microbiol.* 2004; 51: 937-948; Olorunniji et al., "Synapsis and catalysis by activated Tn3 resolvase mutants." *Nucleic Acids Res.* 2008; 36: 7181-7191; Rowland et al., "Regulatory mutations in Sin recombinase support a structure-based model of the synaptosome." *Mol Microbiol.* 2009; 74: 282-298; Akopian et al., "Chimeric recombinases with designed DNA sequence recognition." *Proc Natl Acad Sci USA.* 2003; 100: 8688-8691; Gordley et al., "Evolution of programmable zinc finger-recombinases with activity in human cells. *J Mol Biol.* 2007; 367: 802-813; Gordley et al., "Synthesis of programmable integrases." *Proc Natl Acad Sci USA.* 2009; 106: 5053-5058; Arnold et al., "Mutants of Tn3 resolvase which do not require accessory binding sites for recombination activity." *EMBO J.* 1999; 18: 1407-1414; Gaj et al., "Structure-guided reprogramming of serine recombinase DNA sequence specificity." *Proc Natl Acad Sci USA.* 2011; 108(2):498-503; and Proudfoot et al., "Zinc finger recombinases with adaptable DNA sequence specificity." *PLoS One.* 2011; 6(4):e19537; the entire contents of each are hereby incorporated by reference. For example, serine recombinases of the resolvase-invertase group, e.g., Tn3 and γδ resolvases and the Hin and Gin invertases, have modular structures with autonomous catalytic and DNA-binding domains (See, e.g., Grindley et al., "Mechanism of site-specific recombination." *Ann Rev Biochem.* 2006; 75: 567-605, the entire contents of which are incorporated by reference). The catalytic domains of these recombinases are thus amenable to being recombined with nuclease-inactivated RNA-programmable nucleases (e.g., dCas9, or a fragment thereof) as described herein, e.g., following the isolation of 'activated' recombinase mutants which do not require any accessory factors (e.g., DNA binding activities) (See, e.g., Klippel et al., "Isolation and characterisation of unusual gin mutants." *EMBO J.* 1988; 7: 3983-3989: Burke et al., "Activating mutations of Tn3 resolvase marking interfaces important in recombination catalysis and its regulation. *Mol Microbiol.* 2004; 51: 937-948; Olorunniji et al., "Synapsis and catalysis by activated Tn3 resolvase mutants." *Nucleic Acids Res.* 2008; 36: 7181-7191; Rowland et al., "Regulatory mutations in Sin recombinase support a structure-based model of the synaptosome." *Mol Microbiol.* 2009; 74: 282-298; Akopian et al., "Chimeric recombinases with designed DNA sequence recognition." *Proc Natl Acad Sci USA.* 2003; 100: 8688-8691). Additionally, many other natural serine recombinases having an N-terminal catalytic domain and a C-terminal DNA binding domain are known (e.g., phiC31 integrase, TnpX transposase, IS607 transposase), and their catalytic domains can be co-opted to engineer programmable site-specific recombinases as described herein (See, e.g., Smith et al., "Diversity in the serine recombinases." *Mol Microbiol.* 2002; 44: 299-307, the entire contents of which are incorporated by reference). Similarly, the core catalytic domains of tyrosine recombinases (e.g., Cre, λ integrase) are known, and can be similarly co-opted to engineer programmable site-specific recombinases as described herein (See, e.g., Guo et al., "Structure of Cre recombinase complexed with DNA in a site-specific recombination synapse." *Nature.* 1997; 389:40-46; Hartung et al., "Cre mutants with altered DNA binding properties." *J Biol Chem* 1998; 273:22884-22891; Shaikh et al., "Chimeras of the Flp and Cre recombinases: Tests of the mode of cleavage by Flp and Cre. *J Mol Biol.* 2000; 302:27-48; Rongrong et al., "Effect of deletion mutation on the recombination activity of Cre recombinase." *Acta Biochim Pol.* 2005; 52:541-544; Kilbride et al., "Determinants of product topology in a hybrid Cre-Tn3 resolvase site-specific recombination system." *J Mol Biol.* 2006; 355:185-195; Warren et al., "A chimeric cre recombinase with regulated directionality." *Proc Natl Acad Sci USA.* 2008 105:18278-18283; Van Duyne, "Teaching Cre to follow directions." *Proc Natl Acad Sci USA.* 2009 Jan. 6; 106(1):4-5; Numrych et al., "A comparison of the effects of single-base and triple-base changes in the integrase arm-type binding sites on the site-specific recombination of bacteriophage λ." *Nucleic Acids Res.* 1990; 18:3953-3959; Tirumalai et al., "The recognition of core-type DNA sites by k integrase." *J Mol Biol.* 1998; 279:513-527; Aihara et al., "A conformational switch controls the DNA cleavage activity of λ integrase." *Mol Cell.* 2003; 12:187-198; Biswas et al., "A structural basis for allosteric control of DNA recombination by λ integrase." *Nature.* 2005; 435:1059-1066; and Warren et al., "Mutations in the amino-terminal domain of λ-integrase have differential effects on integrative and excisive recombination." *Mol Microbiol.* 2005; 55:1104-1112; the entire contents of each are incorporated by reference).

Recombinase Recognition Sequence

The term "recombinase recognition sequence", or equivalently as "RRS" or "recombinase target sequence", as used herein, refers to a nucleotide sequence target recognized by a recombinase and which undergoes strand exchange with another DNA molecule having a the RRS that results in excision, integration, inversion, or exchange of DNA fragments between the recombinase recognition sequences.

Recombine or Recombination

The term "recombine," or "recombination," in the context of a nucleic acid modification (e.g., a genomic modification), is used to refer to the process by which two or more nucleic acid molecules, or two or more regions of a single nucleic acid molecule, are modified by the action of a recombinase protein (e.g., an inventive recombinase fusion protein provided herein). Recombination can result in, inter alia, the insertion, inversion, excision, or translocation of nucleic acids, e.g., in or between one or more nucleic acid molecules. recombinase recognition sequences Reverse Transcriptase The term "reverse transcriptase" describes a class of polymerases characterized as RNA-dependent DNA polymerases. All known reverse transcriptases require a primer to synthesize a DNA transcript from an RNA template. Historically, reverse transcriptase has been used primarily to transcribe mRNA into cDNA which can then be cloned into a vector for further manipulation. Avian myoblastosis virus (AMV) reverse transcriptase was the first widely used RNA-dependent DNA polymerase (Verma, Biochim. Biophys. Acta 473:1 (1977)). The enzyme has 5'-3' RNA-directed DNA polymerase activity, 5'-3' DNA-directed DNA polymerase activity, and RNase H activity. RNase H is a processive 5' and 3' ribonuclease specific for the RNA strand for RNA-DNA hybrids (Perbal, A Practical Guide to Molecular Cloning, New York: Wiley & Sons (1984)). Errors in transcription cannot be corrected by reverse transcriptase because known viral reverse transcriptases lack the 3'-5' exonuclease activity necessary for proofreading (Saunders and Saunders, Microbial Genetics Applied to Biotechnology, London: Croom Helm (1987)). A detailed study of the activity of AMV reverse transcriptase and its associated RNase H activity has been presented by Berger et al., Biochemistry 22:2365-2372 (1983). Another reverse transcriptase which is used extensively in molecular biology is reverse transcriptase originating from Moloney murine leukemia virus (M-MLV). See, e.g., Gerard, G. R., DNA 5:271-279 (1986) and Kotewicz, M. L., et al., Gene 35:249-258 (1985). M-MLV reverse transcriptase substantially lacking in RNase H activity has also been described. See, e.g., U.S. Pat. No. 5,244,797. The invention contemplates the use of any such reverse transcriptases, or variants or mutants thereof.

In addition, the invention contemplates the use of reverse transcriptases which are error-prone, i.e., which may be referred to as error-prone reverse transcriptases or reverse transcriptases which do not support high fidelity incorporation of nucleotides during polymerization. During synthesis of the single-strand DNA flap based on the RT template integrated with the guide RNA, the error-prone reverse transcriptase can introduce one or more nucleotides which are mismatched with the RT template sequence, thereby introducing changes to the nucleotide sequence through erroneous polymerization of the single-strand DNA flap. These errors introduced during synthesis of the single strand DNA flap then become integrated into the double strand molecule through hybridization to the corresponding endogenous target strand, removal of the endogenous displaced strand, ligation, and then through one more round of endogenous DNA repair and/or sequencing processes.

Reverse Transcription

As used herein, the term "reverse transcription" indicates the capability of enzyme to synthesize DNA strand (that is, complementary DNA or cDNA) using RNA as a template. In some embodiments, the reverse transcription can be "error-prone reverse transcription," which refers to the properties of certain reverse transcriptase enzymes which are error-prone in their DNA polymerization activity.

PACE

The term "phage-assisted continuous evolution (PACE)," as used herein, refers to continuous evolution that employs phage as viral vectors. The general concept of PACE technology has been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015, International PCT Application, PCT/US2015/012022, filed Jan. 20, 2015, published as WO 2015/134121 on Sep. 11, 2015, and International PCT Application, PCT/US2016/027795, filed Apr. 15, 2016, published as WO 2016/168631 on Oct. 20, 2016, the entire contents of each of which are incorporated herein by reference.

Phage

The term "phage," as used herein interchangeably with the term "bacteriophage," refers to a virus that infects bacterial cells. Typically, phages consist of an outer protein capsid enclosing genetic material. The genetic material can be ssRNA, dsRNA, ssDNA, or dsDNA, in either linear or circular form. Phages and phage vectors are well known to those of skill in the art and non-limiting examples of phages that are useful for carrying out the PACE methods provided herein are λ (Lysogen), T2, T4, T7, T12, R17, M13, MS2, G4, P1, P2, P4, Phi X174, N4, Φ6, and Φ29. In certain embodiments, the phage utilized in the present invention is M13. Additional suitable phages and host cells will be apparent to those of skill in the art and the invention is not limited in this aspect. For an exemplary description of additional suitable phages and host cells, see Elizabeth Kutter and Alexander Sulakvelidze: Bacteriophages: Biology and Applications. CRC Press; 1st edition (December 2004), ISBN: 0849313368; Martha R. J. Clokie and Andrew M. Kropinski: Bacteriophages: Methods and Protocols, Volume 1: Isolation, Characterization, and Interactions (Methods in Molecular Biology) Humana Press; 1st edition (December, 2008), ISBN: 1588296822; Martha R. J. Clokie and Andrew M. Kropinski: Bacteriophages: Methods and Protocols, Volume 2: Molecular and Applied Aspects (Methods in Molecular Biology) Humana Press; 1st edition (December 2008), ISBN: 1603275649; all of which are incorporated herein in their entirety by reference for disclosure of suitable phages and host cells as well as methods and protocols for isolation, culture, and manipulation of such phages).

Protein, Peptide, and Polypeptide

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Protein Splicing

The term "protein splicing," as used herein, refers to a process in which a sequence, an intein (or split inteins, as the case may be), is excised from within an amino acid sequence, and the remaining fragments of the amino acid sequence, the exteins, are ligated via an amide bond to form a continuous amino acid sequence. The term "trans" protein splicing refers to the specific case where the inteins are split inteins and they are located on different proteins.

Second-Strand Nicking

The resolution of heteroduplex DNA (i.e., containing one edited and one non-edited strand) formed as a result of prime editing determines long-term editing outcomes. In words, a goal of prime editing is to resolve the heteroduplex DNA (the edited strand paired with the endogenous non-edited strand) formed as an intermediate of PE by permanently integrating the edited strand into the complement, endogenous strand. The approach of "second-strand nicking" can be used herein to help drive the resolution of heteroduplex DNA in favor of permanent integration of the edited strand into the DNA molecule. As used herein, the concept of "second-strand nicking" refers to the introduction of a second nick at a location downstream of the first nick (i.e., the initial nick site that provides the free 3' end for use in priming of the reverse transcriptase on the extended portion of the guide RNA), preferably on the unedited strand. In certain embodiments, the first nick and the second nick are on opposite strands. In other embodiments, the first nick and the second nick are on opposite strands. In yet another embodiment, the first nick is on the non-target strand (i.e., the strand that forms the single strand portion of the R-loop), and the second nick is on the target strand. In still other embodiments, the first nick is on the edited strand, and the second nick is on the unedited strand. The second nick can be positioned at least 5 nucleotides downstream of the first nick, or at least 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 110, 120, 130, 140, or 150 or more nucleotides downstream of the first nick. The second nick, in certain embodiments, can be introduced between about 5-150 nucleotides on the unedited strand away from the site of the PEgRNA-induced nick, or between about 5-140, or between about 5-130, or between about 5-120, or between about 5-110, or between about 5-100, or between about 5-90, or between about 5-80, or between about 5-70, or between about 5-60, or between about 5-50, or between about 5-40, or between about 5-30, or between about 5-20, or between about 5-10. In one embodiment, the second nick is introduced between 14-116 nucleotides away from the PEgRNA-induced nick. Without being bound by theory, the second nick induces the cell's endogenous DNA repair and replication processes towards replacement or editing of the unedited strand, thereby permanently installing the edited sequence on both strands and resolving the heteroduplex that is formed as a result of PE. In some embodiments, the edited strand is the non-target strand and the unedited strand is the target strand. In other embodiments, the edited strand is the target strand, and the unedited strand is the non-target strand.

Sense Strand

In genetics, a "sense" strand is the segment within double-stranded DNA that runs from 5' to 3', and which is complementary to the antisense strand of DNA, or template strand, which runs from 3' to 5'. In the case of a DNA segment that encodes a protein, the sense strand is the strand of DNA that has the same sequence as the mRNA, which takes the antisense strand as its template during transcription, and eventually undergoes (typically, not always) translation into a protein. The antisense strand is thus responsible for the RNA that is later translated to protein, while the sense strand possesses a nearly identical makeup to that of the mRNA. Note that for each segment of dsDNA, there will possibly be two sets of sense and antisense, depending on which direction one reads (since sense and antisense is relative to perspective). It is ultimately the gene product, or mRNA, that dictates which strand of one segment of dsDNA is referred to as sense or antisense.

In the context of a PEgRNA, the first step is the synthesis of a single-strand complementary DNA (i.e., the 3' ssDNA flap, which becomes incorporated) oriented in the 5' to 3' direction which is templated off of the PEgRNA extension arm. Whether the 3' ssDNA flap should be regarded as a sense or antisense strand depends on the direction of transcription since it well accepted that both strands of DNA may serve as a template for transcription (but not at the same time). Thus, in some embodiments, the 3' ssDNA flap (which overall runs in the 5' to 3' direction) will serve as the sense strand because it is the coding strand. In other embodiments, the 3' ssDNA flap (which overall runs in the 5' to 3' direction) will serve as the antisense strand and thus, the template for transcription.

Spacer Sequence

As used herein, the term "spacer sequence" in connection with a guide RNA or a PEgRNA refers to the portion of the guide RNA or PEgRNA of about 20 nucleotides which contains a nucleotide sequence that is complementary to the protospacer sequence in the target DNA sequence. The spacer sequence anneals to the protospacer sequence to form a ssRNA/ssDNA hybrid structure at the target site and a corresponding R loop ssDNA structure of the endogenous DNA strand that is complementary to the protospacer sequence.

Subject

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

Split Intein

Although inteins are most frequently found as a contiguous domain, some exist in a naturally split form. In this case, the two fragments are expressed as separate polypeptides and must associate before splicing takes place, so-called protein trans-splicing.

An exemplary split intein is the Ssp DnaE intein, which comprises two subunits, namely, DnaE-N and DnaE-C. The two different subunits are encoded by separate genes, namely dnaE-n and dnaE-c, which encode the DnaE-N and DnaE-C subunits, respectively. DnaE is a naturally occurring split intein in *Synechocytis* sp. PCC6803 and is capable of directing trans-splicing of two separate proteins, each comprising a fusion with either DnaE-N or DnaE-C.

Additional naturally occurring or engineered split-intein sequences are known in the or can be made from whole-intein sequences described herein or those available in the art. Examples of split-intein sequences can be found in Stevens et al., "A promiscuous split intein with expanded protein engineering applications," PNAS, 2017, Vol. 114: 8538-8543; Iwai et al., "Highly efficient protein trans-splicing by a naturally split DnaE intein from *Nostc punctiforme*, FEBS Lett, 580: 1853-1858, each of which are incorporated herein by reference. Additional split intein sequences can be found, for example, in WO 2013/045632, WO 2014/055782, WO 2016/069774, and EP2877490, the contents each of which are incorporated herein by reference.

In addition, protein splicing in trans has been described in vivo and in vitro (Shingledecker, et al., *Gene* 207:187 (1998), Southworth et al., *EMBO J.* 17:918 (1998); Mills, et al., *Proc. Natl. Acad. Sci. USA*, 95:3543-3548 (1998); Lew, et al., *J. Biol. Chem.*, 273:15887-15890 (1998); Wu, et al., *Biochim. Biophys. Acta* 35732:1 (1998b), Yamazaki, et al., *J. Am. Chem. Soc.* 120:5591 (1998), Evans, et al., *J. Biol. Chem.* 275:9091 (2000); Otomo, et al., *Biochemistry* 38:16040-16044 (1999); Otomo, et al., *J. Biolmol. NMR* 14:105-114 (1999); Scott, et al., *Proc. Natl. Acad. Sci. USA* 96:13638-13643 (1999)) and provides the opportunity to express a protein as to two inactive fragments that subsequently undergo ligation to form a functional product, e.g., as shown in FIGS. 66 and 67 with regard to the formation of a complete PE fusion protein from two separately-expressed halves.

Target Site

The term "target site" refers to a sequence within a nucleic acid molecule that is edited by a prime editor (PE) disclosed herein. The target site further refers to the sequence within a nucleic acid molecule to which a complex of the prime editor (PE) and gRNA binds.

tPERT

See definition for "trans prime editor RNA template (tPERT)."

Temporal Second-Strand Nicking

As used herein, the term "temporal second-strand nicking" refers to a variant of second strand nicking whereby the installation of the second nick in the unedited strand occurs only after the desired edit is installed in the edited strand. This avoids concurrent nicks on both strands that could lead to double-stranded DNA breaks. The second-strand nicking guide RNA is designed for temporal control such that the second strand nick is not introduced until after the installation of the desired edit. This is achieved by designing a gRNA with a spacer sequence that matches only the edited strand, but not the original allele. Using this strategy, mismatches between the protospacer and the unedited allele should disfavor nicking by the sgRNA until after the editing event on the PAM strand takes place.

Trans Prime Editing

As used herein, the term "trans prime editing" refers to a modified form of prime editing that utilizes a split PEgRNA, i.e., wherein the PEgRNA is separated into two separate molecules: an sgRNA and a trans prime editing RNA template (tPERT). The sgRNA serves to target the prime editor (or more generally, to target the napDNAbp component of the prime editor) to the desired genomic target site, while the tPERT is used by the polymerase (e.g., a reverse transcriptase) to write new DNA sequence into the target locus once the tPERT is recruited in trans to the prime editor by the interaction of binding domains located on the prime editor and on the tPERT. In one embodiment, the binding domains can include RNA-protein recruitment moieties, such as a MS2 aptamer located on the tPERT and an MS2cp protein fused to the prime editor. An advantage of trans prime editing is that by separating the DNA synthesis template from the guide RNA, one can potentially use longer length templates.

An embodiment of trans prime editing is shown in FIGS. 3G and 3H. FIG. 3G shows the composition of the trans prime editor complex on the left ("RP-PE:gRNA complex), which comprises an napDNAbp fused to each of a polymerase (e.g., a reverse transcriptase) and a rPERT recruiting protein (e.g., MS2sc), and which is complexed with a guide RNA. FIG. 3G further shows a separate tPERT molecule, which comprises the extension arm features of a PEgRNA, including the DNA synthesis template and the primer binding sequence. The tPERT molecule also includes an RNA-protein recruitment domain (which, in this case, is a stem loop structure and can be, for example, MS2 aptamer). As depicted in the process described in FIG. 3H, the RP-PE:gRNA complex binds to and nicks the target DNA sequence. Then, the recruiting protein (RP) recruits a tPERT to co-localize to the prime editor complex bound to the DNA target site, thereby allowing the primer binding site to bind to the primer sequence on the nicked strand, and subsequently, allowing the polymerase (e.g., RT) to synthesize a single strand of DNA against the DNA synthesis template up through the 5' of the tPERT.

While the tPERT is shown in FIG. 3G and FIG. 3H as comprising the PBS and DNA synthesis template on the 5' end of the RNA-protein recruitment domain, the tPERT in other configurations may be designed with the PBS and DNA synthesis template located on the 3' end of the RNA-protein recruitment domain. However, the tPERT with the 5' extension has the advantage that synthesis of the single strand of DNA will naturally terminate at the 5' end of the tPERT and thus, does not risk using any portion of the RNA-protein recruitment domain as a template during the DNA synthesis stage of prime editing.

Trans Prime Editor RNA Template (tPERT)

As used herein, a "trans prime editor RNA template (tPERT)" refers to a component used in trans prime editing, a modified version of prime editing which operates by separating the PEgRNA into two distinct molecules: a guide RNA and a tPERT molecule. The tPERT molecule is programmed to co-localize with the prime editor complex at a target DNA site, bringing the primer binding site and the DNA synthesis template to the prime editor in trans. For example, see FIG. 3G for an embodiment of a trans prime editor (tPE) which shows a two-component system comprising (1) an RP-PE:gRNA complex and (2) a tPERT that includes the primer binding site and the DNA synthesis template joined to an RNA-protein recruitment domain, wherein the RP (recruiting protein) component of the RP-PE:gRNA complex recruits the tPERT to a target site to be edited, thereby associating the PBS and DNA synthesis template with the prime editor in trans. Said another way, the tPERT is engineered to contain (all or part of) the extension arm of a PEgRNA, which includes the primer binding site and the DNA synthesis template.

Transitions

As used herein, "transitions" refer to the interchange of purine nucleobases (A↔G) or the interchange of pyrimidine nucleobases (C↔T). This class of interchanges involves nucleobases of similar shape. The compositions and methods disclosed herein are capable of inducing one or more transitions in a target DNA molecule. The compositions and methods disclosed herein are also capable of inducing both transitions and transversion in the same target DNA molecule. These changes involve A↔G, G↔A, C↔T, or T↔C. In the context of a double-strand DNA with Watson-Crick paired nucleobases, transversions refer to the following base pair exchanges: A:T↔G:C, G:G↔A:T, C:G↔T:A, or T:A↔C:G. The compositions and methods disclosed herein are capable of inducing one or more transitions in a target DNA molecule. The compositions and methods disclosed herein are also capable of inducing both transitions and transversion in the same target DNA molecule, as well as other nucleotide changes, including deletions and insertions.

Transversions

As used herein, "transversions" refer to the interchange of purine nucleobases for pyrimidine nucleobases, or in the reverse and thus, involve the interchange of nucleobases with dissimilar shape. These changes involve T↔A, T↔G, C↔G, C↔A, A↔T, A↔C, G↔C, and G↔T. In the context of a double-strand DNA with Watson-Crick paired nucleobases, transversions refer to the following base pair exchanges: T:A↔A:T, T:A↔G:C, C:G↔G:C, C:G↔A:T, A:T↔T:A, A:T↔C:G, G:C↔C:G, and G:C↔T:A. The compositions and methods disclosed herein are capable of inducing one or more transversions in a target DNA molecule. The compositions and methods disclosed herein are also capable of inducing both transitions and transversion in the same target DNA molecule, as well as other nucleotide changes, including deletions and insertions.

Treatment

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Trinucleotide Repeat Disorder

As used herein, a "trinucleotide repeat disorder" (or alternatively, "expansion repeat disorder" or "repeat expansion disorder") refers to a set of genetic disorders which are cause by "trinucleotide repeat expansion," which is a kind of mutation where a certain trinucleotide repeats in certain genes or introns. Trinucleotide repeats were once thought to be commonplace iterations in the genome, but the 1990s clarified these disorders. These apparently 'benign' stretches of DNA can sometimes expand and cause disease. Several defining features are shared amongst disorders caused by trinucleotide repeat expansions. First, the mutant repeats show both somatic and germline instability and, more frequently, they expand rather than contract in successive transmissions. Secondly, an earlier age of onset and increasing severity of phenotype in subsequent generations (anticipation) generally are correlated with larger repeat length. Finally, the parental origin of the disease allele can often influence anticipation, with paternal transmissions carrying a greater risk of expansion for many of these disorders.

Triplet expansion is thought to be caused by slippage during DNA replication. Due to the repetitive nature of the DNA sequence in these regions 'loop out' structures may form during DNA replication while maintaining complementary base pairing between the parent strand and daughter strand being synthesized. If the loop out structure is formed from sequence on the daughter strand this will result in an increase in the number of repeats. However, if the loop out structure is formed on the parent strand a decrease in the number of repeats occurs. It appears that expansion of these repeats is more common than reduction. Generally the larger the expansion the more likely they are to cause disease or increase the severity of disease. This property results in the characteristic of anticipation seen in trinucleotide repeat disorders. Anticipation describes the tendency of age of onset to decrease and severity of symptoms to increase through successive generations of an affected family due to the expansion of these repeats.

Nucleotide repeat disorders may include those in which the triplet repeat occurs in a non-coding region (i.e., a non-coding trinucleotide repeat disorder) or in a coding region The prime editor (PE) system described herein may use to treat nucleotide repeat disorders, which may include fragile X syndrome (FRAXA), fragile XE MR (FRAXE), *Freidreich ataxia* (FRDA), myotonic dystrophy (DM), spinocerebellar ataxia type 8 (SCA8), and spinocerebellar ataxia type 12 (SCA12), among others.

Upstream

As used herein, the terms "upstream" and "downstream" are terms of relativity that define the linear position of at least two elements located in a nucleic acid molecule (whether single or double-stranded) that is orientated in a 5'-to-3' direction. In particular, a first element is upstream of a second element in a nucleic acid molecule where the first element is positioned somewhere that is 5' to the second element. For example, a SNP is upstream of a Cas9-induced nick site if the SNP is on the 5' side of the nick site. Conversely, a first element is downstream of a second element in a nucleic acid molecule where the first element is positioned somewhere that is 3' to the second element. For example, a SNP is downstream of a Cas9-induced nick site if the SNP is on the 3' side of the nick site. The nucleic acid molecule can be a DNA (double or single stranded), RNA (double or single stranded), or a hybrid of DNA and RNA. The analysis is the same for single strand nucleic acid molecule and a double strand molecule since the terms upstream and downstream are in reference to only a single strand of a nucleic acid molecule, except that one needs to select which strand of the double stranded molecule is being considered. Often, the strand of a double stranded DNA which can be used to determine the positional relativity of at least two elements is the "sense" or "coding" strand. In genetics, a "sense" strand is the segment within double-stranded DNA that runs from 5' to 3', and which is complementary to the antisense strand of DNA, or template strand, which runs from 3' to 5'. Thus, as an example, a SNP nucleobase is "downstream" of a promoter sequence in a genomic DNA (which is double-stranded) if the SNP nucleobase is on the 3' side of the promoter on the sense or coding strand.

Variant

As used herein the term "variant" should be taken to mean the exhibition of qualities that have a pattern that deviates from what occurs in nature, e.g., a variant Cas9 is a Cas9 comprising one or more changes in amino acid residues as compared to a wild type Cas9 amino acid sequence. The term "variant" encompasses homologous proteins having at least 75%, or at least 80%, or at least 85%, or at least 90%, or at least 95%, or at least 99% percent identity with a reference sequence and having the same or substantially the same functional activity or activities as the reference sequence. The term also encompasses mutants, truncations, or domains of a reference sequence, and which display the same or substantially the same functional activity or activities as the reference sequence.

Vector

The term "vector," as used herein, refers to a nucleic acid that can be modified to encode a gene of interest and that is able to enter into a host cell, mutate and replicate within the host cell, and then transfer a replicated form of the vector into another host cell. Exemplary suitable vectors include viral vectors, such as retroviral vectors or bacteriophages and filamentous phage, and conjugative plasmids. Additional suitable vectors will be apparent to those of skill in the art based on the instant disclosure.

Wild Type

As used herein the term "wild type" is a term of the art understood by skilled persons and means the typical form of an organism, strain, gene or characteristic as it occurs in nature as distinguished from mutant or variant forms.

5' Endogenous DNA Flap

As used herein, the term "5' endogenous DNA flap" refers to the strand of DNA situated immediately downstream of the PE-induced nick site in the target DNA. The nicking of the target DNA strand by PE exposes a 3' hydroxyl group on the upstream side of the nick site and a 5' hydroxyl group on the downstream side of the nick site. The endogenous strand ending in the 3' hydroxyl group is used to prime the DNA polymerase of the prime editor (e.g., wherein the DNA polymerase is a reverse transcriptase). The endogenous strand on the downstream side of the nick site and which begins with the exposed 5' hydroxyl group is referred to as the "5' endogenous DNA flap" and is ultimately removed and replaced by the newly synthesized replacement strand (i.e., "3' replacement DNA flap") the encoded by the extension of the PEgRNA.

5' Endogenous DNA Flap Removal

As used herein, the term "5' endogenous DNA flap removal" or "5' flap removal" refers to the removal of the 5' endogenous DNA flap that forms when the RT-synthesized single-strand DNA flap competitively invades and hybridizes to the endogenous DNA, displacing the endogenous strand in the process. Removing this endogenous displaced strand can drive the reaction towards the formation of the desired product comprising the desired nucleotide change. The cell's own DNA repair enzymes may catalyze the removal or excision of the 5' endogenous flap (e.g., a flap endonuclease, such as EXO1 or FEN1). Also, host cells may be transformed to express one or more enzymes that catalyze the removal of said 5' endogenous flaps, thereby driving the process toward product formation (e.g., a flap endonuclease). Flap endonucleases are known in the art and can be found described in Patel et al., "Flap endonucleases pass 5'-flaps through a flexible arch using a disorder-thread-order mechanism to confer specificity for free 5'-ends," *Nucleic Acids Research,* 2012, 40(10): 4507-4519 and Tsutakawa et al., "Human flap endonuclease structures, DNA double-base flipping, and a unified understanding of the FEN1 superfamily," *Cell,* 2011, 145(2): 198-211 (each of which are incorporated herein by reference).

3' Replacement DNA Flap

As used herein, the term "3' replacement DNA flap" or simply, "replacement DNA flap," refers to the strand of DNA that is synthesized by the prime editor and which is encoded by the extension arm of the prime editor PEgRNA. More in particular, the 3' replacement DNA flap is encoded by the polymerase template of the PEgRNA. The 3' replacement DNA flap comprises the same sequence as the 5' endogenous DNA flap except that it also contains the edited sequence (e.g., single nucleotide change). The 3' replacement DNA flap anneals to the target DNA, displacing or replacing the 5' endogenous DNA flap (which can be excised, for example, by a 5' flap endonuclease, such as FEN1 or EXO1) and then is ligated to join the 3' end of the 3' replacement DNA flap to the exposed 5' hydoxyl end of endogenous DNA (exposed after excision of the 5' endogenous DNA flap, thereby reforming a phosphodiester bond and installing the 3' replacement DNA flap to form a heteroduplex DNA containing one edited strand and one unedited strand. DNA repair processes resolve the heteroduplex by copying the information in the edited strand to the complementary strand permanently installs the edit in to the DNA. This resolution process can be driven further to completion by nicking the unedited strand, i.e., by way of "second-strand nicking," as described herein.

DETAILED DESCRIPTION OF CERTAIN EMBODIMENTS

Adoption of the clustered regularly interspaced short palindromic repeat (CRISPR) system for genome editing has revolutionized the life sciences[1-3]. Although gene disruption using CRISPR is now routine, the precise installation of single nucleotide edits remains a major challenge, despite being necessary for studying or correcting a large number of disease-causative mutations. Homology directed repair (HDR) is capable of achieving such edits, but suffers from low efficiency (often <5%), a requirement for donor DNA repair templates, and deleterious effects of double-stranded DNA break (DSB) formation. Recently, Prof. David Liu et al.'s laboratory developed base editing, which achieves efficient single nucleotide editing without DSBs. Base editors (BEs) combine the CRISPR system with base-modifying deaminase enzymes to convert target C.G or A.T base pairs to A.T or G.C, respectively[4-6]. Although already widely used by researchers worldwide, current BEs enable only four of the twelve possible base pair conversions and are unable to correct small insertions or deletions. Moreover, the targeting scope of base editing is limited by the editing of non-target C or A bases adjacent to the target base ("bystander editing") and by the requirement that a PAM sequence exist 15±2 bp from the target base. Overcoming these limitations would therefore greatly broaden the basic research and therapeutic applications of genome editing.

The present disclosure proposes a new precision editing approach that offers many of the benefits of base editing—namely, avoidance of double strand breaks and donor DNA repair templates—while overcoming its major limitations. The proposed approach described herein achieves the direct installation of edited DNA strands at target genomic sites using target-primed reverse transcription (TPRT). In the design discussed herein, CRISPR guide RNA (gRNA) will be engineered to carry a reverse transcriptase (RT) template sequence encoding a single-stranded DNA comprising a desired nucleotide change. The CRISPR nuclease (Cas9)-nicked target site DNA will serve as the primer for reverse transcription of the template sequence on the modified gRNA, allowing for direct incorporation of any desired nucleotide edit.

Accordingly, the present invention relates in part to the discovery that the mechanism of target-primed reverse transcription (TPRT) can be leveraged or adapted for conducting precision CRISPR/Cas-based genome editing with high efficiency and genetic flexibility (e.g., as depicted in various embodiments of FIGS. 1A-1F). The inventors have proposed herein to use Cas protein-reverse transcriptase fusions to target a specific DNA sequence with a modified guide RNA ("an extended guide RNA"), generate a single strand nick at the target site, and use the nicked DNA as a primer for reverse transcription of an engineered reverse transcriptase template that is integrated into the extended guide RNA. The newly synthesized strand would be homologous to the genomic target sequence except for the inclusion of a desired nucleotide change (e.g., a single nucleotide change, a deletion, or an insertion, or a combination thereof). The newly synthesize strand of DNA may be referred to as a single strand DNA flap, which would compete for hybridization with the complementary homologous endogenous DNA strand, thereby displacing the corresponding endogenous strand. Resolution of this hybridized intermediate can include removal of the resulting displaced flap of endogenous DNA (e.g., with a 5' end DNA flap endonuclease, FEN1), ligation of the synthesized single strand DNA flap to the target DNA, and assimilation of the desired nucleotide change as a result of cellular DNA repair and/or replication processes. Because templated DNA synthesis offers single nucleotide precision, the scope of this approach is very broad and could foreseeably be used for myriad applications in basic science and therapeutics.

[1] napDNAbp

The prime editors and trans prime editors described herein may comprise a nucleic acid programmable DNA binding protein (napDNAbp).

In one aspect, a napDNAbp can be associated with or complexed with at least one guide nucleic acid (e.g., guide RNA or a PEgRNA), which localizes the napDNAbp to a DNA sequence that comprises a DNA strand (i.e., a target strand) that is complementary to the guide nucleic acid, or a portion thereof (e.g., the spacer of a guide RNA which anneals to the protospacer of the DNA target). In other words, the guide nucleic-acid "programs" the napDNAbp (e.g., Cas9 or equivalent) to localize and bind to complementary sequence of the protospacer in the DNA.

Any suitable napDNAbp may be used in the prime editors described herein. In various embodiments, the napDNAbp may be any Class 2 CRISPR-Cas system, including any type II, type V, or type VI CRISPR-Cas enzyme. Given the rapid development of CRISPR-Cas as a tool for genome editing, there have been constant developments in the nomenclature used to describe and/or identify CRISPR-Cas enzymes, such as Cas9 and Cas9 orthologs. This application references CRISPR-Cas enzymes with nomenclature that may be old and/or new. The skilled person will be able to identify the specific CRISPR-Cas enzyme being referenced in this Application based on the nomenclature that is used, whether it is old (i.e., "legacy") or new nomenclature. CRISPR-Cas nomenclature is extensively discussed in Makarova et al., "Classification and Nomenclature of CRISPR-Cas Systems: Where from Here?," *The CRISPR Journal*, Vol. 1. No. 5, 2018, the entire contents of which are incorporated herein by reference. The particular CRISPR-Cas nomenclature used in any given instance in this Application is not limiting in any way and the skilled person will be able to identify which CRISPR-Cas enzyme is being referenced.

For example, the following type II, type V, and type VI Class 2 CRISPR-Cas enzymes have the following art-recognized old (i.e., legacy) and new names. Each of these enzymes, and/or variants thereof, may be used with the prime editors described herein:

| Legacy nomenclature | Current nomenclature* |
|---|---|
| type II CRISPR-Cas enzymes | |
| Cas9 | same |
| type V CRISPR-Cas enzymes | |
| Cpf1 | Cas12a |
| CasX | Cas12e |
| C2c1 | Cas12b1 |
| Cas12b2 | same |
| C2c3 | Cas12c |
| CasY | Cas12d |
| C2c4 | same |
| C2c8 | same |
| C2c5 | same |
| C2c10 | same |
| C2c9 | same |
| type VI CRISPR-Cas enzymes | |
| C2c2 | Cas13a |
| Cas13d | same |
| C2c7 | Cas13c |
| C2c6 | Cas136 |

*See Makarova et al., The CRISPR Journal, Vol. 1, No. 5, 2018

Without being bound by theory, the mechanism of action of certain napDNAbp contemplated herein includes the step of forming an R-loop whereby the napDNAbp induces the unwinding of a double-strand DNA target, thereby separating the strands in the region bound by the napDNAbp. The guide RNA spacer then hybridizes to the "target strand" at the protospacer sequence. This displaces a "non-target strand" that is complementary to the target strand, which forms the single strand region of the R-loop. In some embodiments, the napDNAbp includes one or more nuclease activities, which then cut the DNA leaving various types of lesions. For example, the napDNAbp may comprises a nuclease activity that cuts the non-target strand at a first location, and/or cuts the target strand at a second location. Depending on the nuclease activity, the target DNA can be cut to form a "double-stranded break" whereby both strands are cut. In other embodiments, the target DNA can be cut at only a single site, i.e., the DNA is "nicked" on one strand. Exemplary napDNAbp with different nuclease activities include "Cas9 nickase" ("nCas9") and a deactivated Cas9 having no nuclease activities ("dead Cas9" or "dCas9").

The below description of various napDNAbps which can be used in connection with the presently disclose prime editors is not meant to be limiting in any way. The prime editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 variants have a nickase activity, i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats).

The prime editors described herein may also comprise Cas9 equivalents, including Cas12a (Cpf1) and Cas12b1 proteins which are the result of convergent evolution. The napDNAbps used herein (e.g., SpCas9, Cas9 variant, or Cas9 equivalents) may also may also contain various modifications that alter/enhance their PAM specifities. Lastly, the application contemplates any Cas9, Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequence or a reference Cas9 equivalent (e.g., Cas12a (Cpf1)).

The napDNAbp can be a CRISPR (clustered regularly interspaced short palindromic repeat)-associated nuclease. As outlined above, CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M. et al., Science 337:816-821(2012), the entire contents of which is hereby incorporated by reference.

In some embodiments, the napDNAbp directs cleavage of one or both strands at the location of a target sequence, such as within the target sequence and/or within the complement of the target sequence. In some embodiments, the napDNAbp directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a napDNAbp that is mutated to with respect to a corresponding wild-type enzyme such that the mutated napDNAbp lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A in reference to the canonical SpCas9 sequence, or to equivalent amino acid positions in other Cas9 variants or Cas9 equivalents.

As used herein, the term "Cas protein" refers to a full-length Cas protein obtained from nature, a recombinant Cas protein having a sequences that differs from a naturally occurring Cas protein, or any fragment of a Cas protein that nevertheless retains all or a significant amount of the requisite basic functions needed for the disclosed methods, i.e., (i) possession of nucleic-acid programmable binding of the Cas protein to a target DNA, and (ii) ability to nick the target DNA sequence on one strand. The Cas proteins contemplated herein embrace CRISPR Cas 9 proteins, as well as Cas9 equivalents, variants (e.g., Cas9 nickase (nCas9) or nuclease inactive Cas9 (dCas9)) homologs, orthologs, or paralogs, whether naturally occurring or non-naturally occurring (e.g., engineered or recombinant), and may include a Cas9 equivalent from any Class 2 CRISPR system (e.g., type II, V, VI), including Cas12a (Cpf1), Cas12e (CasX), Cas12b1 (C2c1), Cas12b2, Cas12c (C2c3), C2c4, C2c8, C2c5, C2c10, C2c9 Cas13a (C2c2), Cas13d, Cas13c (C2c7), Cas13b (C2c6), and Cas13b. Further Cas-equivalents are described in Makarova et al., "C2c2 is a single-component programmable RNA-guided RNA-targeting CRISPR effector," Science 2016; 353(6299) and Makarova et al., "Classification and Nomenclature of CRISPR-Cas Systems: Where from Here?," *The CRISPR Journal*, Vol. 1. No. 5, 2018, the contents of which are incorporated herein by reference.

The terms "Cas9" or "Cas9 nuclease" or "Cas9 moiety" or "Cas9 domain" embrace any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. The term Cas9 is not meant to be particularly limiting and may be referred to as a "Cas9 or equivalent." Exemplary Cas9 proteins are further described herein and/or are described in the art and are incorporated herein by reference. The present disclosure is unlimited with regard to the particular Cas9 that is employed in the prime editor (PE) of the invention.

As noted herein, Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., *Proc. Natl. Acad. Sci. U.S.A.* 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference).

Examples of Cas9 and Cas9 equivalents are provided as follows; however, these specific examples are not meant to be limiting. The primer editor of the present disclosure may use any suitable napDNAbp, including any suitable Cas9 or Cas9 equivalent.

A. Wild Type Canonical SpCas9

In one embodiment, the primer editor constructs described herein may comprise the "canonical SpCas9" nuclease from *S. pyogenes*, which has been widely used as a tool for genome engineering and is categorized as the type II subgroup of enzymes of the Class 2 CRISPR-Cas systems. This Cas9 protein is a large, multi-domain protein containing two distinct nuclease domains. Point mutations can be introduced into Cas9 to abolish one or both nuclease activities, resulting in a nickase Cas9 (nCas9) or dead Cas9

(dCas9), respectively, that still retains its ability to bind DNA in a sgRNA-programmed manner. In principle, when fused to another protein or domain, Cas9 or variant thereof (e.g., nCas9) can target that protein to virtually any DNA sequence simply by co-expression with an appropriate sgRNA. As used herein, the canonical SpCas9 protein refers to the wild type protein from *Streptococcus pyogenes* having the following amino acid sequence:

| Description | Sequence | SEQ ID NO: |
|---|---|---|
| SpCas9 *Streptococcus pyogenes* M1 SwissProt Accession No. Q99ZW2 Wild type | MDKKYSIGLDIGTNSVGWAVITDEYKVPSKKFKVLGN TDRHSIKKNLIGALLFDSGETAEATRLKRTARRRYTRR KNRICYLQEIFSNEMAKVDDSFFHRLEESFLVEEDKKH ERHPIFGNIVDEVAYHEKYPTIYHLRKKLVDSTDKADL RLIYLALAHMIKFRGHFLIEGDLNPDNSDVDKLFIQLVQ TYNQLFEENPINASGVDAKAILSARLSKSRRLENLIAQL PGEKKNGLFGNLIALSLGLTPNFKSNFDLAEDAKLQLS KDTYDDDLDNLLAQIGDQYADLFLAAKNLSDAILLSDI LRVNTEITKAPLSASMIKRYDEHHQDLTLLKALVRQQL PEKYKEIFFDQSKNGYAGYIDGGASQEEFYKFIKPILEK MDGTEELLVKLNREDLLRKQRTFDNGSIPHQIHLGELH AILRRQEDFYPFLKDNREKIEKILTFRIPYYVGPLARGN SRFAWMTRKSEETITPWNFEEVVDKGASAQSFIERMTN FDKNLPNEKVLPKHSLLYEYFTVYNELTKVKYVTEGM RKPAFLSGEQKKAIVDLLFKTNRKVTVKQLKEDYFKKI ECFDSVETSGVEDRFNASLGTYHDLLKIIKDKDFLDNEE NEDILEDIVLTLTLFEDREMIEERLKTYAHLFDDKVMK QLKRRRYTGWGRLSRKLINGIRDKQSGKTILDFLKSDG FANRNFMQLIHDDSLTFKEDIQKAQVSGQGDSLHEHIA NLAGSPAIKKGILQTVKVVDELVKVMGRHKPENIVIEM ARENQTTQKGQKNSRERMKRIEEGIKELGSQILKEHPV ENTQLQNEKLYLYYLQNGRDMYVDQELDINRLSDYD VDHIVPQSFLKDDSIDNKVLTRSDKNRGKSDNVPSEEV VKKMKNYWRQLLNAKLITQRKFDNLTKAERGGLSEL DKAGFIKRQLVETRQITKHVAQILDSRMNTKYDENDK LIREVKVITLKSKLVSDFRKDFQFYKVREINNYHHAHD AYLNAVVGTALIKKYPKLESEFVYGDYKVYDVRKMIA KSEQEIGKATAKYFFYSNIMNFFKTEITLANGEIRKRPLI ETNGETGEIVWDKGRDFATVRKVLSMPQVNIVKKTEV QTGGFSKESILPKRNSDKLIARKKDWDPKKYGGFDSPT VAYSVLVVAKVEKGKSKKLKSVKELLGITIMERSSFEK NP1DFLEAKGYKEVKKDLIIKLPKYSLFELENGRKRML ASAGELQKGNELALPSKYVNFLYLASHYEKLKGSPED NEQKQLFVEQHKHYLDEIIEQISEFSKRVILADANLDKV LSAYNKHRDKPIREQAENIIHLFTLTNLGAPAAFKYFDT TIDRKRYTSTKEVLDATLIHQSITGLYETRIDLSQLGGD | SEQ ID NO: 18 |
| SpCas9 Reverse translation of SwissProt Accession No. Q99ZW2 *Streptococcus pyogenes* | ATGGATAAAAAATATAGCATTGGCCTGGATATTGGC ACCAACAGCGTGGGCTGGGCGGTGATTACCGATGAA TATAAAGTGCCGAGCAAAAAATTTAAAGTGCTGGGC AACACCGATCGCCATAGCATTAAAAAAAACCTGATT GGCGCGCTGCTGTTTGATAGCGGCGAAACCGCGGAA GCGACCCGCCTGAAACGCACCGCGCGCCGCCGCTAT ACCCGCCGCAAAAACCGCATTTGCTATCTGCAGGAA ATTTTTAGCAACGAAATGGCGAAAGTGGATGATAGC TTTTTTCATCGCCTGGAAGAAAGCTTTCTGGTGGAAG AAGATAAAAAACATGAACGCCATCCGATTTTTGGCA ACATTGTGGATGAAGTGGCGTATCATGAAAAATATC CGACCATTTATCATCTGCGCAAAAAACTGGTGGATA GCACCGATAAAGCGGATCTGCGCCTGATTTATCTGG CGCTGGCGCATATGATTAAATTTCGCGGCCATTTTCT GATTGAAGGCGATCTGAACCCGGATAACAGCGATGT GGATAAACTGTTTATTCAGCTGGTGCAGACCTATAA CCAGCTGTTTGAAGAAAACCCGATTAACGCGAGCGG CGTGGATGCGAAAGCGATTCTGAGCGCGCGCCTGAG CAAAAGCCGCCGCCTGGAAAACCTGATTGCGCAGCT GCCGGGCGAAAAAAAAAACGGCCTGTTTGGCAACCT GATTGCGCTGAGCCTGGGCCTGACCCCGAACTTTAA AAGCAACTTTGATCTGGCGGAAGATGCGAAACTGCA GCTGAGCAAAGATACCTATGATGATGATCTGGATAA CCTGCTGGCGCAGATTGGCGATCAGTATGCGGATCT GTTTCTGGCGGCGAAAAACCTGAGCGATGCGATTCT GCTGAGCGATATTCTGCGCGTGAACACCGAAATTAC CAAAGCGCCGCTGAGCGCGAGCATGATTAAACGCTA TGATGAACATCATCAGGATCTGACCCTGCTGAAAGC GCTGGTGCGCCAGCAGCTGCCGGAAAAATATAAAG AAATTTTTTTTGATCAGAGCAAAAACGGCTATGCGG GCTATATTGATGGCGGCGCGAGCCAGGAAGAATTTT ATAAATTTATTAAACCGATTCTGGAAAAAATGGATG GCACCGAAGAACTGCTGGTGAAACTGAACCGCGAA GATCTGCTGCGCAAACAGCGCACCTTTGATAACGGC AGCATTCCGCATCAGATTCATCTGGGCGAACTGCAT | SEQ ID NO: 19 |

-continued

| Description | Sequence | SEQ ID NO: |
|---|---|---|
| | GCGATTCTGCGCCGCCAGGAAGATTTTTATCCGTTTC | |
| | TGAAAGATAACCGCGAAAAAATTGAAAAAATTCTG | |
| | ACCTTTCGCATTCCGTATTATGTGGGCCCGCTGGCGC | |
| | GCGGCAACAGCCGCTTTGCGTGGATGACCCGCAAAA | |
| | GCGAAGAAACCATTACCCCGTGGAACTTTGAAGAAG | |
| | TGGTGGATAAAGGCGCGAGCGCGCAGAGCTTTATTG | |
| | AACGCATGACCAACTTTGATAAAAACCTGCCGAACG | |
| | AAAAAGTGCTGCCGAAACATAGCCTGCTGTATGAAT | |
| | ATTTTACCGTGTATAACGAACTGACCAAAGTGAAAT | |
| | ATGTGACCGAAGGCATGCGCAAACCGGCGTTTCTGA | |
| | GCGGCGAACAGAAAAAAGCGATTGTGGATCTGCTGT | |
| | TTAAAACCAACCGCAAAGTGACCGTGAAACAGCTGA | |
| | AAGAAGATTATTTTAAAAAAATTGAATGCTTTGATA | |
| | GCGTGGAAATTAGCGGCGTGGAAGATCGCTTTAACG | |
| | CGAGCCTGGGCACCTATCATGATCTGCTGAAAATTA | |
| | TTAAAGATAAAGATTTTCTGGATAACGAAGAAAACG | |
| | AAGATATTCTGGAAGATATTGTGCTGACCCTGACCC | |
| | TGTTTGAAGATCGCGAAATGATTGAAGAACGCCTGA | |
| | AAACCTATGCGCATCTGTTTGATGATAAAGTGATGA | |
| | AACAGCTGAAACGCCGCCGCTATACCGGCTGGGGCC | |
| | GCCTGAGCCGCAAACTGATTAACGGCATTCGCGATA | |
| | AACAGAGCGGCAAAACCATTCTGGATTTTCTGAAAA | |
| | GCGATGGCTTTGCGAACCGCAACTTTATGCAGCTGA | |
| | TTCATGATGATAGCCTGACCTTTAAAGAAGATATTC | |
| | AGAAAGCGCAGGTGAGCGGCCAGGGCGATAGCCTG | |
| | CATGAACATATTGCGAACCTGGCGGGCAGCCCGGCG | |
| | ATTAAAAAAGGCATTCTGCAGACCGTGAAAGTGGTG | |
| | GATGAACTGGTGAAAGTGATGGGCCGCCATAAACCG | |
| | GAAAACATTGTGATTGAAATGGCGCGCGAAAACCA | |
| | GACCACCCAGAAAGGCCAGAAAAACAGCCGCGAAC | |
| | GCATGAAACGCATTGAAGAAGGCATTAAAGAACTG | |
| | GGCAGCCAGATTCTGAAAGAACATCCGGTGGAAAA | |
| | CACCCAGCTGCAGAACGAAAAACTGTATCTGTATTA | |
| | TCTGCAGAACGGCCGCGATATGTATGTGGATCAGGA | |
| | ACTGGATATTAACCGCCTGAGCGATTATGATGTGGA | |
| | TCATATTGTGCCGCAGAGCTTTCTGAAAGATGATAG | |
| | CATTGATAACAAAGTGCTGACCCGCAGCGATAAAAA | |
| | CCGCGGCAAAAGCGATAACGTGCCGAGCGAAGAAG | |
| | TGGTGAAAAAAATGAAAAACTATTGGCGCCAGCTGC | |
| | TGAACGCGAAACTGATTACCCAGCGCAAATTTGATA | |
| | ACCTGACCAAAGCGGAACGCGGCGGCCTGAGCGAA | |
| | CTGGATAAAGCGGGCTTTATTAAACGCCAGCTGGTG | |
| | GAAACCCGCCAGATTACCAAACATGTGGCGCAGATT | |
| | CTGGATAGCCGCATGAACACCAATATGATGAAAAC | |
| | GATAAACTGATTCGCGAAGTGAAAGTGATTACCCTG | |
| | AAAAGCAAACTGGTGAGCGATTTTCGCAAAGATTTT | |
| | CAGTTTTATAAAGTGCGCGAAATTAACAACTATCAT | |
| | CATGCGCATGATGCGTATCTGAACGCGGTGGTGGGC | |
| | ACCGCGCTGATTAAAAAATATCCGAAACTGGAAAGC | |
| | GAATTTGTGTATGGCGATTATAAAGTGTATGATGTG | |
| | CGCAAAATGATTGCGAAAAGCGAACAGGAAATTGG | |
| | CAAAGCGACCGCGAAATATTTTTTTATAGCAACAT | |
| | TATGAACTTTTTTAAAACCGAAATTACCCTGGCGAA | |
| | CGGCGAAATTCGCAAACGCCCGCTGATTGAAACCAA | |
| | CGGCGAAACCGGCGAAATTGTGTGGGATAAAGGCC | |
| | GCGATTTTGCGACCGTGCGCAAAGTGCTGAGCATGC | |
| | CGCAGGTGAACATTGTGAAAAAAACCGAAGTGCAG | |
| | ACCGGCGGCTTTAGCAAAGAAAGCATTCTGCCGAAA | |
| | CGCAACAGCGATAAACTGATTGCGCGCAAAAAAGA | |
| | TTGGGATCCGAAAAAATATGGCGGCTTTGATAGCCC | |
| | GACCGTGGCGTATAGCGTGCTGGTGGTGGCGAAAGT | |
| | GGAAAAAGGCAAAAGCAAAAAACTGAAAAGCGTGA | |
| | AAGAACTGCTGGGCATTACCATTATGGAACGCAGCA | |
| | GCTTTGAAAAAAACCCGATTGATTTTCTGGAAGCGA | |
| | AAGGCTATAAAGAAGTGAAAAAAGATCTGATTATTA | |
| | AACTGCCGAAATATAGCCTGTTTGAACTGGAAAACG | |
| | GCCGCAAACGCATGCTGGCGAGCGCGGGCGAACTG | |
| | CAGAAAGGCAACGAACTGGCGCTGCCGAGCAAATA | |
| | TGTGAACTTTCTGTATCTGGCGAGCCATTATGAAAA | |
| | ACTGAAAGGCAGCCCGGAAGATAACGAACAGAAAC | |
| | AGCTGTTTGTGGAACAGCATAAACATTATCTGGATG | |
| | AAATTATTGAACAGATTAGCGAATTTAGCAAACGCG | |
| | TGATTCTGGCGGATGCGAACCTGGATAAAGTGCTGA | |
| | GCGCGTATAACAAACATCGCGATAAACCGATTCGCG | |
| | AACAGGCGGAAAACATTATTCATCTGTTTACCCTGA | |
| | CCAACCTGGGCGCGCCGGCGGCGTTTAAATATTTTG | |
| | ATACCACCATTGATCGCAAACGCTATACCAGCACCA | |

| Description | Sequence | SEQ ID NO: |
|---|---|---|
| | AAGAAGTGCTGGATGCGACCCTGATTCATCAGAGCA TTACCGGCCTGTATGAAACCCGCATTGATCTGAGCC AGCTGGGCGGCGAT | |

The prime editors described herein may include canonical SpCas9, or any variant thereof having at least 80%, at least 85%, at least 90%, at least 95%, or at least 99% sequence identity with a wild type Cas9 sequence provided above.

These variants may include SpCas9 variants containing one or more mutations, including any known mutation reported with the SwissProt Accession No. Q99ZW2 (SEQ ID NO: 18) entry, which include:

| SpCas9 mutation (relative to the amino acid sequence of the canonical SpCas9 sequence, SEQ ID NO: 18) | Function/Characteristic (as reported) (see UniProtKB - Q99ZW2 (CAS9_STRPT1) entry - incorporated herein by reference) |
|---|---|
| D10A | Nickase mutant which cleaves the protospacer strand (but no cleavage of non-protospacer strand) |
| S15A | Decreased DNA cleavage activity |
| R66A | Decreased DNA cleavage activity |
| R70A | No DNA cleavage |
| R74A | Decreased DNA cleavage |
| R78A | Decreased DNA cleavage |
| 97-150 deletion | No nuclease activity |
| R165A | Decreased DNA cleavage |
| 175-307 deletion | About 50% decreased DNA cleavage |
| 312-409 deletion | No nuclease activity |
| E762A | Nickase |
| H840A | Nickase mutant which cleaves the non-protospacer strand but does not cleave the protospacer strand |
| N854A | Nickase |
| N863A | Nickase |
| H982A | Decreased DNA cleavage |
| D986A | Nickase |
| 1099-1368 deletion | No nuclease activity |
| R1333A | Reduced DNA binding |

Other wild type SpCas9 sequences that may be used in the present disclosure, include:

| Description | Sequence | SEQ ID NO: |
|---|---|---|
| SpCas9 Streptococcus pyogenes MGAS1882 wild type NC_017053.1 | ATGGATAAGAAATACTCAATAGGCTTAGATATCGGCA CAAATAGCGTCGGATGGGCGGTGATCACTGATGATTA TAAGGTTCCGTCTAAAAAGTTCAAGGTTCTGGGAAAT ACAGACCGCCACAGTATCAAAAAAAATCTTATAGGGG CTCTTTTATTTGGCAGTGGAGAGACAGCGGAAGCGAC TCGTCTCAAACGGACAGCTCGTAGAAGGTATACACGT CGGAAGAATCGTATTTGTTATCTACAGGAGATTTTTC AAATGAGATGGCGAAAGTAGATGATAGTTTCTTTCATC GACTTGAAGAGTCTTTTTTGGTGGAAGAAGACAAGAA GCATGAACGTCATCCTATTTTTTGGAAATATAGTAGATG AAGTTGCTTATCATGAGAAATATCCAACTATCTATCAT CTGCGAAAAAAATTGGCAGATTCTACTGATAAAGCGG ATTTGCGCTTAATCTATTTGGCCTTAGCGCATATGATT AAGTTTCGTGGTCATTTTTTGATTGAGGGAGATTTAAA TCCTGATAATAGTGATGTGGACAAACTATTTATCCAGT TGGTACAAATCTACAATCAATTATTTGAAGAAAACCCT ATTAACGCAAGTAGAGTAGATGCTAAAGCGATTCTTTC TGCACGATTGAGTAAATCAAGACGATTAGAAAATCTC ATTGCTCAGCTCCCCGGTGAGAAGAGAAATGGCTTGTT TGGGAATCTCATTGCTTTGTCATTGGGATTGACCCCTA ATTTTAAATCAAATTTTGATTTGGCAGAAGATGCTAAA TTACAGCTTTCAAAAGATACTTACGATGATGATTTAGA TAATTTATTGGCGCAAATTGGAGATCAATATGCTGATT TGTTTTTGGCAGCTAAGAATTTATCAGATGCTATTTTA CTTTCAGATATCCTAAGAGTAAATAGTGAAATAACTA AGGCTCCCCTATCAGCTTCAATGATTAAGCGCTACGAT GAACATCATCAAGACTTGACTCTTTTAAAAGCTTTAGT TCGACAACAACTTCCAGAAAAGTATAAAGAAATCTTT TTTGATCAATCAAAAAACGGATATGCAGGTTATATTGA TGGGGGAGCTAGCCAAGAAGAATTTTATAAATTTATC AAACCAATTTTAGAAAAAATGGATGGTACTGAGGAAT | SEQ ID NO: 20 |

| Description | Sequence | SEQ ID NO: |
|---|---|---|
| | TATTGGTGAAACTAAATCGTGAAGATTTGCTGCGCAA | |
| | GCAACGGACCTTTGACAACGGCTCTATTCCCCATCAAA | |
| | TTCACTTGGGTGAGCTGCATGCTATTTTGAGAAGACAA | |
| | GAAGACTTTTATCCATTTTTAAAAGACAATCGTGAGAA | |
| | GATTGAAAAAATCTTGACTTTTCGAATTCCTTATTATG | |
| | TTGGTCCATTGGCGCGTGGCAATAGTCGTTTTGCATGG | |
| | ATGACTCGGAAGTCTGAAGAAACAATTACCCCATGGA | |
| | ATTTTGAAGAAGTTGTCGATAAAGGTGCTTCAGCTCAA | |
| | TCATTTATTGAACGCATGACAAACTTTGATAAAAATCT | |
| | TCCAAATGAAAAGTACTACCAAAACATAGTTTGCTTT | |
| | ATGAGTATTTTACGGTTTATAACGAATTGACAAAGGTC | |
| | AAATATGTTACTGAGGGAATGCGAAAACCAGCATTTC | |
| | TTTCAGGTGAACAGAAGAAAGCCATTGTTGATTTACTC | |
| | TTCAAAACAAATCGAAAAGTAACCGTTAAGCAATTAA | |
| | AAGAAGATTATTTCAAAAAAATAGAATGTTTTGATAG | |
| | TGTTGAAATTTCAGGAGTTGAAGATAGATTTAATGCTT | |
| | CATTAGGCGCCTACCATGATTTGCTAAAAATTATTAAA | |
| | GATAAAGATTTTTTGGATAATGAAGAAAATGAAGATA | |
| | TCTTAGAGGATATTGTTTTAACATTGACCTTATTTGAA | |
| | GATAGGGGGATGATTGAGGAAAGACTTAAAACATATG | |
| | CTCACCTCTTTGATGATAAGGTGATGAAACAGCTTAAA | |
| | CGTCGCCGTTATACTGGTTGGGGACGTTTGTCTCGAAA | |
| | ATTGATTAATGGTATTAGGGATAAGCAATCTGGCAAA | |
| | ACAATATTAGATTTTTTGAAATCAGATGGTTTTGCCAA | |
| | TCGCAATTTTATGCAGCTGATCCATGATGATAGTTTGA | |
| | CATTTAAAGAAGATATTCAAAAAGCACAGGTGTCTGG | |
| | ACAAGGCCATAGTTTACATGAACAGATTGCTAACTTA | |
| | GCTGGCAGTCCTGCTATTAAAAAAGGTATTTTACAGAC | |
| | TGTAAAAATTGTTGATGAACTGGTCAAAGTAATGGGG | |
| | CATAAGCCAGAAAATATCGTTATTGAAATGGCACGTG | |
| | AAAATCAGACAACTCAAAAGGGCCAGAAAAATTCGCG | |
| | AGAGCGTATGAAACGAATCGAAGAAGGTATCAAAGA | |
| | ATTAGGAAGTCAGATTCTTAAAGAGCATCCTGTTGAA | |
| | AATACTCAATTGCAAAATGAAAAGCTCTATCTCTATTA | |
| | TCTACAAAATGGAAGAGACATGTATGTGGACCAAGAA | |
| | TTAGATATTAATCGTTTAAGTGATTATGATGTCGATCA | |
| | CATTGTTCCACAAAGTTTCATTAAAGACGATTCAATAG | |
| | ACAATAAGGTACTAACGCGTTCTGATAAAAATCGTGG | |
| | TAAATCGGATAACGTTCCAAGTGAAGAAGTAGTCAAA | |
| | AAGATGAAAAACTATTGGAGACAACTTCTAAACGCCA | |
| | AGTTAATCACTCAACGTAAGTTTGATAATTTAACGAAA | |
| | GCTGAACGTGGAGGTTTGAGTGAACTTGATAAAGCTG | |
| | GTTTTATCAAACGCCAATTGGTTGAAACTCGCCAAATC | |
| | ACTAAGCATGTGGCACAAATTTTGGATAGTCGCATGA | |
| | ATACTAAATACGATGAAAATGATAAACTTATTCGAGA | |
| | GGTTAAAGTGATTACCTTAAAATCTAAATTAGTTTCTG | |
| | ACTTCCGAAAAGATTTCCAATTCTATAAAGTACGTGAG | |
| | ATTAACAATTACCATCATGCCCATGATGCGTATCTAAA | |
| | TGCCGTCGTTGGAACTGCTTTGATTAAGAAATATCCAA | |
| | AACTTGAATCGGAGTTTGTCTATGGTGATTATAAAGTT | |
| | TATGATGTTCGTAAAATGATTGCTAAGTCTGAGCAAGA | |
| | AATAGGCAAAGCAACCGCAAAATATTTCTTTTACTCTA | |
| | ATATCATGAACTTCTTCAAAACAGAAATTACACTTGCA | |
| | AATGGAGAGATTCGCAAACGCCCTCTAATCGAAACTA | |
| | ATGGGGAAACTGGAGAAATTGTCTGGGATAAAGGGCG | |
| | AGATTTTGCCACAGTGCGCAAAGTATTGTCCATGCCCC | |
| | AAGTCAATATTGTCAAGAAAACAGAAGTACAGACAGG | |
| | CGGATTCTCCAAGGAGTCAATTTTACCAAAAAGAAAT | |
| | TCGGACAAGCTTATTGCTCGTAAAAAAGACTGGGATC | |
| | CAAAAAAATATGGTGGTTTTGATAGTCCAACGGTAGC | |
| | TTATTCAGTCCTAGTGGTTGCTAAGGTGGAAAAAGGG | |
| | AAATCGAAGAAGTTAAAATCCGTTAAAGAGTTACTAG | |
| | GGATCACAATTATGGAAAGAAGTTCCTTTGAAAAAAA | |
| | TCCGATTGACTTTTTAGAAGCTAAAGGATATAAGGAA | |
| | GTTAAAAAAGACTTAATCATTAAACTACCTAAATATA | |
| | GTCTTTTTGAGTTAGAAAACGGTCGTAAACGGATGCTG | |
| | GCTAGTGCCGGAGAATTACAAAAAGGAAATGAGCTGG | |
| | CTCTGCCAAGCAAATATGTGAATTTTTTATATTTAGCT | |
| | AGTCATTATGAAAAGTTGAAGGGTAGTCCAGAAGATA | |
| | ACGAACAAAAACAATTGTTTGTGGAGCAGCATAAGCA | |
| | TTATTTAGATGAGATTATTGAGCAAATCAGTGAATTTT | |
| | CTAAGCGTGTTATTTTAGCAGATGCCAATTTAGATAAA | |
| | GTTCTTAGTGCATATAACAAACATAGAGACAAACCAA | |
| | TACGTGAACAAGCAGAAATATTATTCATTTATTTACG | |
| | TTGACGAATCTTGGAGCTCCCGCTGCTTTTAAATATTT | |
| | TGATACAACAATTGATCGTAAACGATATACGTCTACA | |
| | AAAGAAGTTTTAGATGCCACTCTTATCCATCAATCCAT | |

| Description | Sequence | SEQ ID NO: |
|---|---|---|
| | CACTGGTCTTTATGAAACACGCATTGATTTGAGTCAGC TAGGAGGTGACTGA | |
| SpCas9 Streptococcus pyogenes MGAS1882 wild type NC_017053.1 | MDKKYSIGLDIGTNSVGWAVITDDYKVPSKKFKVLGNT DRHSIKKNLIGALLFGSGETAEATRLKRTARRRYTRRKN RICYLQEIFSNEMAKVDDSFFHRLEESFLVEEDKKHERHP IFGNIVDEVAYHEKYPTIYHLRKKLADSTDKADLRLIYLA LAHMIKFRGHFLIEGDLNPDNSDVDKLFIQLVQIYNQLFE ENPINASRVDAKAILSARLSKSRRLENLIAQLPGEKRNGL FGNLIALSLGLTPNFKSNFDLAEDAKLQLSKDTYDDDLD NLLAQIGDQYADLFLAAKNLSDAILLSDILRVNSEITKAP LSASMIKRYDEHHQDLTLLKALVRQQLPEKYKEIFFDQS KNGYAGYIDGGASQEEFYKFIKPILEKMDGTEELLVKLN REDLLRKQRTFDNGSIPHQIHLGELHAILRRQEDFYPFLK DNREKIEKILTFRIPYYVGPLARGNSRFAWMTRKSEETITP WNFEEVVDKGASAQSFIERMTNFDKNLPNEKVLPKHSLL YEYFTVYNELTKVKYVTEGMRKPAFLSGEQKKAIVDLLF KTNRKVTVKQLKEDYFKKIECFDSVEISGVEDRFNASLG AYHDLLKIIKDKDFLDNEENEDILEDIVLTLTLFEDRGMIE ERLKTYAHLFDDKVMKQLKRRRYTGWGRLSRKLINGIR DKQSGKTILDFLKSDGFANRNFMQLIHDDSLTFKEDIQKA QVSGQGHSLHEQIANLAGSPAIKKGILQTVKIVDELVKV MGHKPENIVIEMARENQTTQKGQKNSRERMKRIEEGIKE LGSQILKEHPVENTQLQNEKLYLYYLQNGRDMYVDQEL DINRLSDYDVDHIVPQSFIKDDSIDNKVLTRSDKNRGKSD NVPSEEVVKKMKNYWRQLLNAKLITQRKFDNLTKAERG GLSELDKAGFIKRQLVETRQITKHVAQILDSRMNTKYDE NDKLIREVKVITLKSKLVSDFRKDFQFYKVREINNYHHA HDAYLNAVVGTALIKKYPKLESEFVYGDYKVYDVRKMI AKSEQEIGKATAKYFFYSNIMNFFKTEITLANGEIRKRPLI ETNGETGEIVWDKGRDFATVRKVLSMPQVNIVKKTEVQ TGGFSKESILPKRNSDKLIARKKDWDPKKYGGFDSPTVA YSVLVVAKVEKGKSKKLKSVKELLGITIMERSSFEKNPlD FLEAKGYKEVKKDLIIKLPKYSLFELENGRKRMLASAGE LQKGNELALPSKYVNFLYLASHYEKLKGSPEDNEQKQLF VEQHKHYLDEIIEQISEFSKRVILADANLDKVLSAYNKHR DKPlREQAENIIHLFTLTNLGAPAAFKYFDTTIDRKRYTST KEVLDATLIHQSITGLYETRIDLSQLGGD | SEQ ID NO: 21 |
| SpCas9 Streptococcus pyogenes wild type SWBC2D7W 014 | ATGGATAAAAAGTATTCTATTGGTTTAGACATCGGCAC TAATTCCGTTGGATGGGCTGTCATAACCGATGAATACA AAGTACCTTCAAAGAAATTTAAGGTGTTGGGGAACAC AGACCGTCATTCGATTAAAAAGAATCTTATCGGTGCCC TCCTATTCGATAGTGGCGAAACGGCAGAGGCGACTCG CCTGAAACGAACCGCTCGGAGAAGGTATACACGTCGC AAGAACCGAATATGTTACTTACAAGAAATTTTTAGCA ATGAGATGGCCAAAGTTGACGATTCTTTCTTTCACCGT TTGGAAGAGTCCTTCCTTGTCGAAGAGGACAAGAAAC ATGAACGGCACCCCATCTTTGGAAACATAGTAGATGA GGTGGCATATCATGAAAAGTACCCAACGATTTATCAC CTCAGAAAAAAGCTAGTTGACTCAACTGATAAAGCGG ACCTGAGGTTAATCTACTTGGCTCTTGCCCATATGATA AAGTTCCGTGGGCACTTTCTCATTGAGGGTGATCTAAA TCCGGACAACTCGGATGTCGACAAACTGTTCATCCAGT TAGTACAAATCTATAATCAGTTGTTTGAAGAGAACCCT ATAAATGCAAGTGGCGTGGATGCGAAGGCTATTCTTA GCGCCCGCCTCTCTAAATCCCGACGGCTAGAAAACCT GATCGCACAATTACCCGGAGAAGAAAAATGGGTTG TTCGGTAACCTTATAGCGCTCTCACTAGGCCTGACACC AAATTTTAAGTCGAACTTCGACTTAGCTGAAGATGCCA AATTGCAGCTTAGTAAGGACACGTACGATGACGATCT CGACAATCTACTGGCACAAATTGGAGATCAGTATGCG GACTTATTTTTGGCTGCCAAAAACCTTAGCGATGCAAT CCTCCTATCTGACATACTGAGAGTTAATACTGAGATTA CCAAGGCGCCGTTATCCGCTTCAATGATCAAAAGGTA CGATGAACATCACCAAGACTTGACACTTCTCAAGGCC CTAGTCCGTCAGCAACTGCCTGAGAAATATAAGGAAA TATTCTTTGATCAGTCGAAAAACGGGTACGCAGGTTAT ATTGACGGCGGAGCGAGTCAAGAGGAATTCTACAAGT TTATCAAACCCATATTAGAGAAGATGGATGGGACGGA AGAGTTGCTTGTAAAACTCAATCGCGAAGATCTACTGC GAAAGCAGCGGACTTTCGACAACGGTAGCATTCCACA TCAAATCCACTTAGGCGAATTGCATGCTATACTTAGAA GGCAGGAGGATTTTTATCCGTTCCTCAAAGACAATCGT GAAAAGATTGAGAAAATCCTAACCTTTCGCATACCTTA CTATGTGGGACCCCTGGCCCGAGGGAACTCTCGGTTCG CATGGATGACAAGAAAGTCCGAAGAAACGATTACTCC | SEQ ID NO: 22 |

| Description | Sequence | SEQ ID NO: |
|---|---|---|
| | ATGGAATTTTGAGGAAGTTGTCGATAAAGGTGCGTCA | |
| | GCTCAATCGTTCATCGAGAGGATGACCAACTTTGACA | |
| | AGAATTTACCGAACGAAAAAGTATTGCCTAAGCACAG | |
| | TTTACTTTACGAGTATTTCACAGTGTACAATGAACTCA | |
| | CGAAAGTTAAGTATGTCACTGAGGGCATGCGTAAACC | |
| | CGCCTTTCTAAGCGGAGAACAGAAGAAAGCAATAGTA | |
| | GATCTGTTATTCAAGACCAACCGCAAAGTGACAGTTA | |
| | AGCAATTGAAAGAGGACTACTTTAAGAAAATTGAATG | |
| | CTTCGATTCTGTCGAGATCTCCGGGGTAGAAGATCGAT | |
| | TTAATGCGTCACTTGGTACGTATCATGACCTCCTAAAG | |
| | ATAATTAAAGATAAGGACTTCCTGGATAACGAAGAGA | |
| | ATGAAGATATCTTAGAAGATATAGTGTTGACTCTTACC | |
| | CTCTTTGAAGATCGGGAAATGATTGAGGAAAGACTAA | |
| | AAACATACGCTCACCTGTTCGACGATAAGGTTATGAA | |
| | ACAGTTAAAGAGGCGTCGCTATACGGGCTGGGACGA | |
| | TTGTCGCGGAAACTTATCAACGGGATAAGAGACAAGC | |
| | AAAGTGGTAAAACTATTCTCGATTTTCTAAAGAGCGAC | |
| | GGCTTCGCCAATAGGAACTTTATGCAGCTGATCCATGA | |
| | TGACTCTTTAACCTTCAAAGAGGATATACAAAAGGCA | |
| | CAGGTTTCCGGACAAGGGGACTCATTGCACGAACATA | |
| | TTGCGAATCTTGCTGGTTCGCCAGCCATCAAAAAGGGC | |
| | ATACTCCAGACAGTCAAAGTAGTGGATGAGCTAGTTA | |
| | AGGTCATGGGACGTCACAAACCGGAAAACATTGTAAT | |
| | CGAGATGGCACGCGAAAATCAAACGACTCAGAAGGG | |
| | GCAAAAAAACAGTCGAGAGCGGATGAAGAGAATAGA | |
| | AGAGGGTATTAAAGAACTGGGCAGCCAGATCTTAAAG | |
| | GAGCATCCTGTGGAAAATACCCAATTGCAGAACGAGA | |
| | AACTTTACCTCTATTACCTACAAAATGGAAGGGACATG | |
| | TATGTTGATCAGGAACTGGACATAAACCGTTTATCTGA | |
| | TTACGACGTCGATCACATTGTACCCCAATCCTTTTTGA | |
| | AGGACGATTCAATCGACAATAAAGTGCTTACACGCTC | |
| | GGATAAGAACCGAGGGAAAAGTGACAATGTTCCAAGC | |
| | GAGGAAGTCGTAAAGAAAATGAAGAACTATTGGCGGC | |
| | AGCTCCTAAATGCGAAACTGATAACGCAAAGAAAGTT | |
| | CGATAACTTAACTAAAGCTGAGAGGGGTGGCTTGTCT | |
| | GAACTTGACAAGGCCGGATTTATTAAACGTCAGCTCGT | |
| | GGAAACCCGCCAAATCACAAAGCATGTTGCACAGATA | |
| | CTAGATTCCCGAATGAATACGAAATACGACGAGAACG | |
| | ATAAGCTGATTCGGGAAGTCAAAGTAATCACTTTAAA | |
| | GTCAAAATTGGTGTCGGACTTCAGAAAGGATTTTCAAT | |
| | TCTATAAAGTTAGGGAGATAAATAACTACCACCATGC | |
| | GCACGACGCTTATCTTAATGCCGTCGTAGGGACCGCAC | |
| | TCATTAAGAAATACCCGAAGCTAGAAAGTGAGTTTGT | |
| | GTATGGTGATTACAAAGTTTATGACGTCCGTAAGATGA | |
| | TCGCGAAAAGCGAACAGGAGATAGGCAAGGCTACAG | |
| | CCAAATACTTCTTTTATTCTAACATTATGAATTTCTTTA | |
| | AGACGGAAATCACTCTGGCAAACGGAGAGATACGCAA | |
| | ACGACCTTTAATTGAAACCAATGGGGAGACAGGTGAA | |
| | ATCGTATGGGATAAGGGCCGGGACTTCGCGACGGTGA | |
| | GAAAAGTTTTGTCCATGCCCCAAGTCAACATAGTAAA | |
| | GAAAACTGAGGTGCAGACCGGAGGGTTTTCAAAGGAA | |
| | TCGATTCTTCCAAAAAGGAATAGTGATAAGCTCATCGC | |
| | TCGTAAAAAGGACTGGGACCCGAAAAAGTACGGTGGC | |
| | TTCGATAGCCCTACAGTTGCCTATTCTGTCCTAGTAGT | |
| | GGCAAAAGTTGAGAAGGGAAAATCCAAGAAACTGAA | |
| | GTCAGTCAAAGAATTATTGGGGATAACGATTATGGAG | |
| | CGCTCGTCTTTTGAAAAGAACCCCATCGACTTCCTTGA | |
| | GGCGAAAGGTTACAAGGAAGTAAAAAAGGATCTCATA | |
| | ATTAAACTACCAAAGTATAGTCTGTTTGAGTTAGAAAA | |
| | TGGCCGAAAACGGATGTTGGCTAGCGCCGGAGAGCTT | |
| | CAAAAGGGGAACGAACTCGCACTACCGTCTAAATACG | |
| | TGAATTTCCTGTATTTAGCGTCCCATTACGAGAAGTTG | |
| | AAAGGTTCACCTGAAGATAACGAACAGAAGCAACTTT | |
| | TTGTTGAGCAGCACAAACATTATCTCGACGAAATCATA | |
| | GAGCAAATTTCGGAATTCAGTAAGAGAGTCATCCTAG | |
| | CTGATGCCAATCTGGACAAAGTATTAAGCGCATACAA | |
| | CAAGCACAGGGATAAACCCATACGTGAGCAGGCGGAA | |
| | AATATTATCCATTTGTTTACTCTTACCAACCTCGGCGCT | |
| | CCAGCCGCATTCAAGTATTTTGACACAACGATAGATCG | |
| | CAAACGATACACTTCTACCAAGGAGGTGCTAGACGCG | |
| | ACACTGATTCACCAATCCATCACGGGATTATATGAAAC | |
| | TCGGATAGATTTGTCACAGCTTGGGGGTGACGGATCCC | |
| | CCAAGAAGAAGAGGAAAGTCTCGAGCGACTACAAAG | |
| | ACCATGACGGTGATTATAAAGATCATGACATCGATTA | |
| | CAAGGATGACGATGACAAGGCTGCAGGA | |

-continued

| Description | Sequence | SEQ ID NO: |
|---|---|---|
| SpCas9 *Streptococcus pyogenes* wild type Encoded product of SWBC2D7W 014 | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVEISGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKVM GRHKPENIVIEMARENQTTQKGQKNSRERMKRIEEGIKE LGSQILKEHPVENTQLQNEKLYLYYLQNGRDMYVDQEL DINRLSDYDVDHIVPQSFLKDDSIDNKVLTRSDKNRGKS DNVPSEEVVKKMKNYWRQLLNAKLITQRKFDNLTKAER GGLSELDKAGFIKRQLVETRQITKHVAQILDSRMNTKYD ENDKLIREVKVITLKSKLVSDFRKDFQFYKVREINNYHH AHDAYLNAVVGTALIKKYPKLESEFVYGDYKVYDVRK MIAKSEQEIGKATAKYFFYSNIMNFFKTEITLANGEIRKRP LIETNGETGEIVWDKGRDFATVRKVLSMPQVNIVKKTEV QTGGFSKESILPKRNSDKLIARKKDWDPKKYGGFDSPTV AYSVLVVAKVEKGKSKKLKSVKELLGITIMERSSFEKNPI DFLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGDGSPKKKRKVS SDYKDHDGDYKDHDIDYKDDDDKAAG | SEQ ID NO: 23 |
| SpCas9 *Streptococcus pyogenes* M1GAS wild type NC_002737.2 | ATGGATAAGAAATACTCAATAGGCTTAGATATCGGCA CAAATAGCGTCGGATGGGCGGTGATCACTGATGAATA TAAGGTTCCGTCTAAAAAGTTCAAGGTTCTGGGAAAT ACAGACCGCCACAGTATCAAAAAAAATCTTATAGGGG CTCTTTTTATTTGACAGTGGAGAGACAGCGGAAGCGAC TCGTCTCAAACGGACAGCTCGTAGAAGGTATACACGT CGGAAGAATCGTATTTGTTATCTACAGGAGATTTTTTC AAATGAGATGGCGAAAGTAGATGATATGTTTCTTTCATC GACTTGAAGAGTCTTTTTTGGTGGAAGAAGACAAGAA GCATGAACGTCATCCTATTTTTGGAAATATAGTAGATG AAGTTGCTTATCATGAGAAATATCCAACTATCTATCAT CTGCGAAAAAAATTGGTAGATTCTACTGATAAAGCGG ATTTGCGCTTAATCTATTTGGCCTTAGCGCATATGATT AAGTTTCGTGGTCATTTTTTGATTGAGGGAGATTTAAA TCCTGATAATAGTGATGTGGACAAACTATTTATCCAGT TGGTACAAACCTACAATCAATTATTTGAAGAAAACCCT ATTAACGCAAGTGGAGTAGATGCTAAAGCGATTCTTTC TGCACGATTGAGTAAATCAAGACGATTAGAAAATCTC ATTGCTCAGCTCCCCGGTGAGAAGAAAAATGGCTTATT TGGGAATCTCATTGCTTTGTCATTGGGTTTGACCCCTA ATTTTAAATCAAATTTTGATTTGGCAGAAGATGCTAAA TTACAGCTTTCAAAAGATACTTACGATGATGATTTAGA TAATTTATTGGCGCAAATTGGAGATCAATATGCTGATT TGTTTTTGGCAGCTAAGAATTTATCAGATGCTATTTTA CTTTCAGATATCCTAAGAGTAAATACTGAAATAACTAA GGCTCCCCTATCAGCTTCAATGATTAAACGCTACGATG AACATCATCAAGACTTGACTCTTTTAAAAGCTTTAGTT CGACAACAACTTCCAGAAAAGTATAAAGAAATCTTTT TTGATCAATCAAAAAACGGATATGCAGGTTATATTGAT GGGGGAGCTAGCCAAGAAGAATTTTATAAATTTATCA AACCAATTTTAGAAAAAATGGATGGTACTGAGGAATT ATTGGTGAAACTAAATCGTGAAGATTTGCTGCGCAAG CAACGGACCTTTGACAACGGCTCTATTCCCCATCAAAT TCACTTGGGTGAGCTGCATGCTATTTTGAGAAGACAAG AAGACTTTTATCCATTTTTAAAAGACAATCGTGAGAAG ATTGAAAAAATCTTGACTTTTCGAATTCCTTATTATGTT GGTCCATTGGCGCGTGGCAATAGTCGTTTTGCATGGAT GACTCGGAAGTCTGAAGAAACAATTACCCCATGGAAT TTTGAAGAAGTTGTCGATAAAGGTGCTTCAGCTCAATC | SEQ ID NO: 24 |

| Description | Sequence | SEQ ID NO: |
|---|---|---|
| | ATTTATTGAACGCATGACAAACTTTGATAAAAATCTTC<br>CAAATGAAAAAGTACTACCAAAACATAGTTTGCTTTAT<br>GAGTATTTTACGGTTTATAACGAATTGACAAAGGTCAA<br>ATATGTTACTGAAGGAATGCGAAAACCAGCATTTCTTT<br>CAGGTGAACAGAAGAAAGCCATTGTTGATTTACTCTTC<br>AAAACAAATCGAAAAGTAACCGTTAAGCAATTAAAAG<br>AAGATTATTTCAAAAAAATAGAATGTTTTGATAGTGTT<br>GAAATTTCAGGAGTTGAAGATAGATTTAATGCTTCATT<br>AGGTACCTACCATGATTTGCTAAAAATTATTAAAGATA<br>AAGATTTTTTGGATAATGAAGAAAATGAAGATATCTT<br>AGAGGATATTGTTTTAACATTGACCTTATTTGAAGATA<br>GGGAGATGATTGAGGAAAGACTTAAAACATATGCTCA<br>CCTCTTTGATGATAAGGTGATGAAACAGCTTAAACGTC<br>GCCGTTATACTGGTTGGGGACGTTTGTCTCGAAAATTG<br>ATTAATGGTATTAGGGATAAGCAATCTGGCAAAACAA<br>TATTAGATTTTTTGAAATCAGATGGTTTGCCAATCGC<br>AATTTTATGCAGCTGATCCATGATGATAGTTTGACATT<br>TAAAGAAGACATTCAAAAAGCACAAGTGTCTGGACAA<br>GGCGATAGTTTACATGAACATATTGCAAATTTAGCTGG<br>TAGCCCTGCTATTAAAAAAGGTATTTTACAGACTGTAA<br>AAGTTGTTGATGAATTGGTCAAAGTAATGGGGCGGCA<br>TAAGCCAGAAAATATCGTTATTGAAATGGCACGTGAA<br>AATCAGACAACTCAAAAGGGCCAGAAAAATTCGCGAG<br>AGCGTATGAAACGAATCGAAGAAGGTATCAAAGAATT<br>AGGAAGTCAGATTCTTAAAGAGCATCCTGTTGAAAAT<br>ACTCAATTGCAAAATGAAAAGCTCTATCTCTATTATCT<br>CCAAAATGGAAGAGACATGTATGTGGACCAAGAATTA<br>GATATTAATCGTTTAAGTGATTATGATGTCGATCACAT<br>TGTTCCACAAAGTTTCCTTAAAGACGATTCAATAGACA<br>ATAAGGTCTTAACGCGTTCTGATAAAAATCGTGGTAA<br>ATCGGATAACGTTCCAAGTGAAGAAGTAGTCAAAAAG<br>ATGAAAAACTATTGGAGACAACTTCTAAACGCCAAGT<br>TAATCACTCAACGTAAGTTTGATAATTTAACGAAAGCT<br>GAACGTGGAGGTTTGAGTGAACTTGATAAAGCTGGTT<br>TTATCAAACGCCAATTGGTTGAAACTCGCCAAATCACT<br>AAGCATGTGGCACAAATTTTGGATAGTCGCATGAATA<br>CTAAATACGATGAAAATGATAAACTTATTCGAGAGGT<br>TAAAGTGATTACCTTAAAATCTAAATTAGTTTCTGACT<br>TCCGAAAAGATTTCCAATTCTATAAAGTACGTGAGATT<br>AACAATTACCATCATGCCCATGATGCGTATCTAAATGC<br>CGTCGTTGGAACTGCTTTGATTAAGAAATATCCAAAAC<br>TTGAATCGGAGTTTGTCTATGGTGATTATAAAGTTTAT<br>GATGTTCGTAAAATGATTGCTAAGTCTGAGCAAGAAA<br>TAGGCAAAGCAACCGCAAAATATTTCTTTTACTCTAAT<br>ATCATGAACTTCTTCAAAACAGAAATTACACTTGCAAA<br>TGGAGAGATTCGCAAACGCCCTCTAATCGAAACTAAT<br>GGGGAAACTGGAGAAATTGTCTGGGATAAAGGGCGAG<br>ATTTTGCCACAGTGCGCAAAGTATTGTCCATGCCCCAA<br>GTCAATATTGTCAAGAAAACAGAAGTACAGACAGGCG<br>GATTCTCCAAGGAGTCAATTTTACCAAAAAGAAATTC<br>GGACAAGCTTATTGCTCGTAAAAAAGACTGGGATCCA<br>AAAAAATATGGTGGTTTTGATAGTCCAACGGTAGCTTA<br>TTCAGTCCTAGTGGTTGCTAAGGTGGAAAAAGGGAAA<br>TCGAAGAAGTTAAAATCCGTTAAAGAGTTACTAGGGA<br>TCACAATTATGGAAAGAAGTTCCTTTGAAAAAAATCC<br>GATTGACTTTTTAGAAGCTAAAGGATATAAGGAAGTT<br>AAAAAAGACTTAATCATTAAACTACCTAAATATAGTCT<br>TTTTGAGTTAGAAAACGGTCGTAAACGGATGCTGGCT<br>AGTGCCGGAGAATTACAAAAAGGAAATGAGCTGGCTC<br>TGCCAAGCAAATATGTGAATTTTTTATATTTAGCTAGT<br>CATTATGAAAAGTTGAAGGGTAGTCCAGAAGATAACG<br>AACAAAAACAATTGTTTGTGGAGCAGCATAAGCATTA<br>TTTAGATGAGATTATTGAGCAAATCAGTGAATTTTCTA<br>AGCGTGTTATTTTAGCAGATGCCAATTTAGATAAAGTT<br>CTTAGTGCATATAACAAACATAGAGACAAACCAATAC<br>GTGAACAAGCAGAAAATATTATTCATTTATTTACGTTG<br>ACGAATCTTGGAGCTCCCGCTGCTTTTAAATATTTTGA<br>TACAACAATTGATCGTAAACGATATACGTCTACAAAA<br>GAAGTTTTAGATGCCACTCTTATCCATCAATCCATCAC<br>TGGTCTTTATGAAACACGCATTGATTTGAGTCAGCTAG<br>GAGGTGACTGA | |
| SpCas9<br>Streptococcus<br>pyogenes<br>M1GAS wild<br>type | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE | SEQ ID NO:<br>25 |

| Description | Sequence | SEQ ID NO: |
|---|---|---|
| Encoded product of NC_002737.2 (100% identical to the canonical Q99ZW2 wild type) | NPINTASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVEISGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKVM GRHKPENIVIEMARENQTTQKGQKNSRERMKRIEEGIKE LGSQILKEHPVENTQLQNEKLYLYYLQNGRDMYVDQEL DINRLSDYDVDHIVPQSFLKDDSIDNKVLTRSDKNRGKS DNVPSEEVVKKMKNYWRQLLNAKLITQRKFDNLTKAER GGLSELDKAGFIKRQLVETRQITKHVAQILDSRMNTKYD ENDKLIREVKVITLKSKLVSDFRKDFQFYKVREINTNYHH AHDAYLNAVVGTALIKKYPKLESEFVYGDYKVYDVRK MIAKSEQEIGKATAKYFFYSNIMNFFKTEITLANGEIRKRP LIETNGETGEIVWDKGRDFATVRKVLSMPQVNIVKKTEV QTGGFSKESILPKRNSDKLIARKKDWDPKKYGGFDSPTV AYSVLVVAKVEKGKSKKLKSVKELLGITIMERSSFEKNPI DPLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGD | 30 |

The prime editors described herein may include any of the above SpCas9 sequences, or any variant thereof having at least 80%, at least 85%, at least 90%, at least 95%, or at least 99% sequence identity thereto.

B. Wild Type Cas9 Orthologs

In other embodiments, the Cas9 protein can be a wild type Cas9 ortholog from another bacterial species different from the canonical Cas9 from *S. pyogenes*. For example, the following Cas9 orthologs can be used in connection with the prime editor constructs described in this specification. In addition, any variant Cas9 orthologs having at least 80%, at least 85%, at least 90%, at least 95%, or at least 99% sequence identity to any of the below orthologs may also be used with the present prime editors.

| Description | Sequence |
|---|---|
| LfCas9 *Lactobacillus ferrnentum* wild type GenBank: SNX31424.1 1 | MKEYHIGLDIGTSSIGWAVTDSQFKLMRIKGKTAIGVRLFEEGKTAAERR TFRTTRRRLKRRKWRLHYLDEIFAPHLQEVDENFLRRLKQSNIHPEDPTK NQAFIGKLLFPDLLKKNERGYPTLIKMRDELPVEQRAHYPVMNIYKLRE AMINEDRQFDLREVYLAVHHIVKYRGHFLNNASVDKFKVGRIDFDKSFN VLNEAYEELQNGEGSFTIEPSKVEKIGQLLLDTKMRKLDRQKAVAKLLE VKVADKEETKRNKQIATAMSKLVLGYKADFATVAMANGNEWKIDLSS ETSEDEIEKFREELSDAQNDILTEITSLFSQIMLNEIVPNGMSISESMMDRY WTHERQLAEVKEYLATQPASARKEFDQVYNKYIGQAPKERGFDLEKGL KKILSKKENWKEIDELLKAGDFLPKQRTSANGVIPHQMHQQELDRIIEKQ AKYYPWLATENPATGERDRHQAKYELDQLVSFRIPYYVGPLVTPEVQK ATSGAKFAWAKRKEDGEITPWNLWDKIDRAESAEAFIKRMTVKDTYLL NEDVLPANSLLYQKYNVLNELNNVRVNGRRLSVGIKQDIYTELFKKKKT VKASDVASLVMAKTRGVNKPSVEGLSDPKKFNSNLATYLDLKSIVGDK VDDNRYQTDLENIIEWRSVFEDGEIFADKLTEVEWLTDEQRSALVKKRY KGWGRLSKKLLTGIVDENGQRIIDLMWNTDQNFKEIVDQPVFKEQIDQL NQKAITNDGMTLRERVESVLDDAYTSPQNKKAIWQVVRVVEDIVKAVG NAPKSISIEFARNEGNKGEITRSRRTQLQKLFEDQAHELVKDTSLTEELEK APDLSDRYYFYFTQGGKDMYTGDPINFDEISTKYDIDHILPQSFVKDNSL DNRVLTSRKENNKKSDQVPAKLYAAKMKPYWNQLLKQGLITQRKFEN LTKDVDQNIKYRSLGFVKRQLVETRQVIKLTANILGSMYQEAGTEIIETR AGLTKQLREEFDLPKVREVNDYHHAVDAYLTTFAGQYLNRRYPKLRSF FVYGEYMKFKHGSDLKLRNFNFFHELMEGDKSQGKVVDQQTGELITTR DEVAKSFDRLLNMKYMLVSKEVHDRSDQLYGATIVTAKESGKLTSPIEI KKNRLVDLYGAYTNGTSAFMTIIKFTGNKPKYKVIGIPTTSAASLKRAGK PGSESYNQELHRIIKSNPKVKKGFEIVVPHVSYGQLIVDGDCKFTLASPTV QHPATQLVLSKKSLETISSGYKILKDKPAIANERLIRVFDEVVGQMNRYF TIFDQRSNRQKVADARDKFLSLPTESKYEGAKKVQVGKTEVITNLLMGL HANATQGDLKVLGLATFGFFQSTTGLSLSEDTMIVYQSPTGLFERRICLK DI (SEQ ID NO: 26) |
| SaCas9 *Staphylococcus* | MDKKYSIGLDIGTNSVGWAVITDEYKVPSKKFKVLGNTDRHSIKKNLIG ALLFDSGETAEATRLKRTARRRYTRRKNRICYLQEIFSNEMAKVDDSFFH |

| Description | Sequence |
|---|---|
| aureus wild type GenB ank: AYD60528. 1 | RLEESFLVEEDKKHERHPlFGNIVDEVAYHEKYPTIYHLRKKLVDSTDKA DLRLIYLALAHMIKFRGHFLIEGDLNPDNSDVDKLFIQLVQTYNQLFEEN PINASGVDAKAILSARLSKSRRLENLIAQLPGEKKNGLFGNLIALSLGLTP NFKSNFDLAEDAKLQLSKDTYDDDLDNLLAQIGDQYADLFLAAKNLSD AILLSDILRVNTEITKAPLSASMIKRYDEHHQDLTLLKALVRQQLPEKYK EIFFDQSKNGYAGYIDGGASQEEFYKFIKPILEKMDGTEELLVKLNREDL LRKQRTFDNGSIPHQIHLGELHAILRRQEDFYPFLKDNREKIEKILTFRIPY YVGPLARGNSRFAWMTRKSEETITPWNFEEVVDKGASAQSFIERMTNFD KNLPNEKVLPKHSLLYEYFTVYNELTKVKYVTEGMRKPAFLSGEQKKAI VDLLFKTNRKVTVKQLKEDYFKKIECFDSVEISGVEDRFNASLGTYHDL LKIIKDKDFLDNEENEDILEDIVLTLTLFEDREMIEERLKTYAHLFDDKVM KQLKRRRYTGWGRLSRKLINGIRDKQSGKTILDFLKSDGFANRNFMQLI HDDSLTFKEDIQKAQVSGQGDSLHEHIANLAGSPAIKKGILQTVKVVDEL VKVMGRHKPENIVIEMARENQTTQKGQKNSRERMKRIEEGIKELGSQIL KEHPVENTQLQNEKLYLYYLQNGRDMYVDQELDINRLSDYDVDHIVPQ SFLKDDSIDNKVLTRSDKNRGKSDNVPSEEVVKKMKNYWRQLLNAKLI TQRKFDNLTKAERGGLSELDKAGFIKRQLVETRQITKHVAQILDSRMNT KYDENDKLIREVKVITLKSKLVSDFRKDFQFYKVREINNYHHAHDAYLN AVVGTALIKKYPKLESEFVYGDYKVYDVRKMIAKSEQEIGKATAKYFFY SNEVINFFKTEITLANGEIRKRPLIETNGETGEIVWDKGRDFATVRKVLSM PQVNIVKKTEVQTGGFSKESILPKRNSDKLIARKKDWDPKKYGGFDSPT VAYSVLVVAKVEKGKSKKLKSVKELLGITIMERSSFEKNPIDFLEAKGYK EVKKDLIIKLPKYSLFELENGRKRMLASAGELQKGNELALPSKYVNFLY LASHYEKLKGSPEDNEQKQLFVEQHKHYLDEIIEQISEFSKRVILADANL DKVLSAYNKHRDKPIREQAENIIHLFTLTNLGAPAAFKYFDTTIDRKRYT STKEVLDATLIHQSITGLYETRIDLSQLGGD (SEQ ID NO: 27) |
| SaCas9 Staphylococcus aureus | MGKRNYILGLDIGITSVGYGIIDYETRDVIDAGVRLFKEANVENNEGRRS KRGARRLKRRRHRIQRVKKLLFDYNLLTDHSELSGINPYEARVKGLSQ KLSEEEFSAALLHLAKRRGVHNVNEVEEDTGNELSTKEQISRNSKALEE KYVAELQLERLKKDGEVRGSINRFKTSDYVKEAKQLLKVQKAYHQLDQ SFIDTYIDLLETRRTYYEGPGEGSPFGWKDIKEWYEMLMGHCTYFPEELR SVKYAYNADLYNALNDLNNLVITRDENEKLEYYEKFQIIENVFKQKKKP TLKQIAKEILVNEEDIKGYRVTSTGKPEFTNLKVYHDIKDITARKEIIENA ELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSP VVKRSFIQSIKVINAIIKKYGLPNDIIIELAREKNSKDAQKMINEMQKRNR QTNERIEEIIRTTGKENAKYLIEKIKLHDMQEGKCLYSLEAIPLEDLLNNP FNYEVDHIIPRSVSFDNSFNNKVLVKQEENSKKGNRTPFQYLSSSDSKISY ETFKKHILNLAKGKGRISKTKKEYLLEERDINRFSVQKDFINRNLVDTRY ATRGLMNLLRSYFRVNNLDVKVKSINGGFTSFLRRKWKFKKERNKGYK HHAEDALIIANADFIFKEWKKLDKAKKVMENQMFEEKQAESMPEIETEQ EYKEIFITPHQIKHIKDFKDYKYSHRVDKKPNRKLINDTLYSTRKDDKGN TLIVNNLNGLYDKDNDKLKKLINKSPEKLLMYHHDPQTYQKLKLIMEQ YGDEKNPLYKYYEETGNYLTKYSKKDNGPVIKKIKYYGNKLNAHLDIT DDYPNSRNKVVKLSLKPYRFDVYLDNGVYKFVTVKNLDVIKKENYYEV NSKCYEEAKKLKKISNQAEFIASFYKNDLIKINGELYRVIGVNNDLLNRIE VNMIDITYREYLENMNDKRPPHIIKTIASKTQSIKKYSTDILGNLYEVKSK KHPQIIKK (SEQ ID NO: 28) |
| StCas9 Streptococcus thermophilus UniProtKB/ Swiss-Prot: G3ECR1.2 Wild type | MLFNKCIIISINLDFSNKEKCMTKPYSIGLDIGTNSVGWAVITDNYKVPSK KMKVLGNTSKKYIKKNLLGVLLFDSGITAEGRRLKRTARRRYTRRRNRI LYLQEIFSTEMATLDDAFFQRLDDSFLVPDDKRDSKYPIFGNLVEEKVYH DEFPTIYHLRKYLADSTKKADLRLVYLALAHMIKYRGHFLIEGEFNSKN NDIQKNFQDFLDTYNAIFESDLSLENSKQLEEIVKDKISKLEKKDRILKLF PGEKNSGIFSEFLKLIVGNQADFRKCFNLDEKASLHFSKESYDEDLETLL GYIGDDYSDVFLKAKKLYDAILLSGFLTVTDNETEAPLSSAMIKRYNEH KEDLALLKEYIRNISLKTYNEVFKDDTKNGYAGYIDGKTNQEDFYVYLK NLLAEFEGADYFLEKIDREDFLRKQRTFDNGSIPYQIHLQEMRAILDKQA KFYPFLAKNKERIEKILTFRIPYYVGPLARGNSDFAWSIRKRNEKITPWNF EDVIDKESSAEAFINRMTSFDLYLPEEKVLPKHSLLYETFNVYNELTKVR FIAESMRDYQFLDSKQKKDIVRLYFKDRKVTDKDIIEYLHAIYGYDGIE LKGIEKQFNSSLSTYHDLLNIINDKEFLDDSSNEAIIEEIIHTLTIFEDREMIK QRLSKFENIFDKSVLKKLSRRHYTGWGKLSAKLINGIRDEKSGNTILDYLI DDGISNRNFMQLIHDDALSFKKKIQKAQIIGDEDKGNIKEVVKSLPGSPAI KKGILQSIKIVDELVKVMGGRKPESIVVEMARENQYTNQGKSNSQQRLK RLEKSLKELGSKILKEMPAKLSKIDNNALQNDRLYLYYLQNGKDMYTG DDLDIDRLSNYDIDHIIPQAFLKDNSIDNKVLVSSASNRGKSDDFPSLEVV KKRKTFWYQLLKSKLISQRKFDNLTKAERGGLLPEDKAGFIQRQLVETR QITKHVARLLDEKFNNKKDENNRAVRTVKIITLKSTLVSQFRKDFELYK VREINDFHHAHDAYLNAVIASALLKKYPKLEPEFVYGDYPKYNSFRERK SATEKVYFYSNIMNIFKKSISLADGRVIERPLIEVNEETGESVWNKESDLA TVRRVLSYPQVNVVKKVEEQNHGLDRGKPKGLFNANLSSKPKPNSNEN LVGAKEYLDPKKYGGYAGISNSFAVLVKGTIEKGAKKKITNVLEFQGISI LDRINYRKDKLNFLLEKGYKDIELIIELPKYSLFELSDGSRRMLASILSTN NKRGEIHKGNQIFLSQKFVKLLYHAKRISNTINENHRKYVENHKKEFEEL |

| Description | Sequence |
|---|---|
| | FYYILEFNENYVGAKKNGKLLNSAFQSWQNHSIDELCSSFIGPTGSERKG<br>LFELTSRGSAADFEFLGVKIPRYRDYTPSSLLKDATLIHQSVTGLYETR1D<br>LAKLGEG(SEQ ID NO: 29) |
| LcCas9<br>Lactobacillus<br>crispatus<br>NCBI<br>Reference<br>Sequence:<br>WP_133478<br>044.1<br>Wild type | MKIKNYNLALTPSTSAVGHVEVDDDLNILEPVHHQKAIGVAKFGEGETA<br>EARRLARSARRTTKRRANRINHYFNEIMKPEIDKVDPLMFDRIKQAGLSP<br>LDERKEFRTVIFDRPNIASYYHNQFPTIWHLQKYLMITDEKADIRLIYWA<br>LHSLLKHRGHFFNTTPMSQFKPGKLNLKDDMLALDDYNDLEGLSFAVA<br>NSPEIEKVIKDRSMHKKEKIAELKKLIVNDVPDKDLAKRNNKIITQIVNAI<br>MGNSPHLNFIFDMDLDKLTSKAWSFKLDDPELDTKFDAISGSMTDNQIGI<br>FETLQKIYSAISLLDILNGSSNVVDAKNALYDKHKRDLNLYFKFLNTLPD<br>EIAKTLKAGYTLYIGNRKKDLLAARKLLKVNVAKNFSQDDFYKLINKEL<br>KSIDKQGLQTRFSEKVGELVAQNNFLPVQRSSDNVF1PYQLNAITFNKILE<br>NQGKYYDFLVKPNPAKKDRKNAPYELSQLMQFTIPYYVGPLVTPEEQV<br>KSGIPKTSRFAWMVRKDNGAITPWNFYDKVDIEATADKFIKRSIAKDSY<br>LLSELVLPKHSLLYEKYEVFNELSNVSLDGKKLSGGVKQILFNEVFKKTN<br>KVNTSRILKALAKHNIPGSKITGLSNPEEFTSSLQTYNAWKKYFPNQIDNF<br>AYQQDLEKMIEWSTVFEDHKILAKKLDEIEWLDDDQKKFVANTRLRGW<br>GRLSKRLLTGLKDNYGKSIIVIQRLETTKANFQQIVYKPEFREQIDKISQAA<br>AKNQSLEDILANSYTSPSNRKAIRKTMSVVDEYIKLNHGKEPDKIFLMFQ<br>RSEQEKGKQTEARSKQLNRILSQLKADKSANKLFSKQLADEFSNAIKKS<br>KYKLNDKQYFYFQQLGRDALTGEVIDYDELYKYTVLHIIPRSKLTDDSQ<br>NNKVLTKYKIVDGSVALKFGNSYSDALGMPIKAFWTELNRLKLIPKGKL<br>LNLTTDDFSTLNKYQRDGYIARQLVETQQIVKLLATIMQSRFKHTKIIEVR<br>NSQVANIRYQFDYFRIKNLNEYYRGFDAYLAAVVGTYLYKVYPKARRL<br>FVYGQYLKPKKTNQENQDMHLDSEKKSQGFNFLWNLLYGKQDQIFVN<br>GTDVIAFNRKDLITKMNTVYNYKSQKISLAIDYHNGAMFKATLFPRNDR<br>DTAKTRKLIPKKKDYDTDIYGGYTSNVDGYMLLAEIIKRDGNKQYGFYG<br>VPSRLVSELDTLKKTRYTEYEEKLKEIIKPELGVDLKKIKKIKILKNKVPF<br>NQVIIDKGSKFFITSTSYRWNYRQLILSAESQQTLMDLVVDPDFSNHKAR<br>KDARKNADERLIKVYEEILYQVKNYMPMFVELHRCYEKLVDAQKTFKS<br>LKISDKAMVLNQILILLHSNATSPVLEKLGYHTRFTLGKKHNLISENAVL<br>VTQSITGLKENHVSIKQML (SEQ ID NO: 30) |
| PdCas9<br>Pediococcus<br>damnosus<br>NCBI<br>Reference<br>Sequence:<br>WP_062913<br>273.1<br>Wild type | MTNEKYSIGLDIGTSSIGFAVVNDNNRVIRVKGKNAIGVRLFDEGKAAA<br>DRRSFRTTRRSFRTTRRRLSRRRWRLKLLREIFDAYITPVDEAFFIRLKES<br>NLSPKDSKKQYSGDILFNDRSDKDFYEKYPTIYHLRNALMTEHRKFDVR<br>EIYLAIHHIMKFRGHFLNATPANNFKVGRLNLEEKFEELNDIYQRVFPDE<br>SIEFRTDNLEQIKEVLLDNKRSRADRQRTLVSDIYQSSEDKDIEKRNKAV<br>ATEILKASLGNKAKLNVITNVEVDKEAAKEWSITFDSESIDDDLAKIEGQ<br>MTDDGHEIIEVLRSLYSGITLSAIVPENHTLSQSMVAKYDLHKDHLKLFK<br>KLINGMTDTKKAKNLRAAYDGYIDGVKGKVLPQEDFYKQVQVNLDDS<br>AEANEIQTYIDQDIFMPKQRTKANGSIPHQLQQQELDQIIENQKAYYPWL<br>AELNPNPDKKRQQLAKYKLDELVTFRVPYYVGPMITAKDQKNQSGAEF<br>AWMIRKEPGNITPWNFDQKVDRMATANQFIKRMTTTDTYLLGEDVLPA<br>QSLLYQKFEVLNELNKIRIDHKPISIEQKQQIFNDLFKQFKNVTIKHLQDY<br>LVSQGQYSKRPLIEGLADEKRFNSSLSTYSDLCGIFGAKLVEENDRQEDL<br>EKIIEWSTIFEDKKIYRAKLNDLTWLTDDQKEKLATKRYQGWGRLSRKL<br>LVGLKNSEHRNIMDILWITNENFMQIQAEPDFAKLVTDANKGMLEKTDS<br>QDVINDLYTSPQNKKAIRQILLVVHDIQNAMHGQAPAKIHVEFARGEER<br>NPRRSVQRQRQVEAAYEKVSNELVSAKVRQEFKEAINNKRDFKDRLFL<br>YFMQGGIDIYTGKQLNIDQLSSYQIDHILPQAFVKDDSLTNRVLTNENQV<br>KADSVPIDIFGKKMLSVWGRMKDQGLISKGKYRNLTMNPENISAHTENG<br>FINRQLVETRQVIKLAVNILADEYGDSTQIISVKADLSHQMREDFELLKN<br>RDVNDYHHAFDAYLAAFIGNYLLKRYPKLESYFVYGDFKKFTQKETKM<br>RRFNFIYDLKHCDQVVNKETGEILWTKDEDIKYIRHLFAYKKILVSHEVR<br>EKRGALYNQTIYKAKDDKGSGQESKKLIRIKDDKETKIYGGYSGKSLAY<br>MTIVQITKKNKVSYRVIGIPTLALARLNKLENDSTENNGELYKIIKPQFTH<br>YKVDKKNGEIIETTDDFKIVVSKVRFQQLIDDAGQFFMLASDTYKNNAQ<br>QLVISNNALKAINNTNITDCPRDDLERLDNLRLDSAFDEIVKKMDKYFSA<br>YDANNFREKIRNSNLIFYQLPVEDQWENNKITELGKRTVLTRILQGLHAN<br>ATTTDMSIFKIKTPFGQLRQRSGISLSENAQLIYQSPTGLFERRVQLNKIK<br>(SEQ ID NO: 31) |
| FnCas9<br>Fusobacterium<br>nucleatum<br>NCBI<br>Reference<br>Sequence:<br>WP_060798<br>984.1 | MKKQKFSDYYLGFDIGTNSVGWCVTDLDYNVLRFNKKDMWGSRLFEE<br>AKTAAERRVQRNSRRRLKRRKWRLNLLEEIFSNEILKIDSNPFRRLKESSL<br>WLEDKSSKEKFTLFNDDNYKDYDFYKQYPTIFHLRNELIKNPEKKIARLV<br>YLAIHSIFKSRGHFLFEGQNLKEIKNFETLYNNLIAFLEDNGINKIIDKNNI<br>EKLEKIVCDSKKGLKDKEKEFEIFNSDKQLVAIFKLSVGSSVSLNDLFD<br>TDEYKKGEVEKEKISFREQIYEDDKPIYYSILGEKIELLDIAKTFYDFMVL<br>NNILADSQYISEAKVKLYEEHKKDLKNLKYIIRKYNKGNYDKLFKDKNE<br>NNYSAYIGLNKEKSKKEVIEKSRLKIDDLIKNIKGYLPKVEEIEEKDKAIF<br>NKILNKIELKTILPKQRISDNGTLPYQIHEAELEKILENQSKYYDFLNYEE<br>NGIITKDKLLMTFKFRIPYYVGPLNSYHKDKGGNSWIVRKEEGKILPWNF<br>EQKVDIEKSAEEFIKRMTNKCTYLNGEDVIPKDTFLYSEYVILNELNKVQ<br>VNDEFLNEENKKIIDELFKENKKVSEKKFKEYLLVKQIVDGTIELKGVK<br>DSFNSNYISYIRFKDIFGEKLNLDIYKEISEKSILWKCLYGDDKKIFEKKIK |

| Description | Sequence |
|---|---|
| | NEYGDILTKDEIKKINTFKFNNWGRLSEKLLTGIEFINLETGECYSSVMDA<br>LRRTNYNLMELLSSKFTLQESINNENKEMNEASYRDLIEESYVSPSLKRAI<br>FQTLKIYEEIRKITGRVPKKVFIEMARGGDESMKNKKIPARQEQLKKLYD<br>SCGNDIANFSIDIKEMKNSLISYDNNSLRQKKLYLYYLQFGKCMYTGREI<br>DLDRLLQNNDTYDIDHIYPRSKVIKDDSFDNLVLVLKNENAEKSNEYPV<br>KKEIQEKMKSFWRFLKEKNFISDEKYKRLTGKDDFELRGFMARQLVNV<br>RQTTKEVGKILQQIEPEIKIVYSKAEIASSFREMFDFIKVRELNDTHHAKD<br>AYLNIVAGNVYNTKFTEKPYRYLQEIKENYDVKKIYNYDIKNAWDKEN<br>SLEIVKKNMEKNTVNITRFIKEKKGQLFDLNPIKKGETSNEIISIKPKVYN<br>GKDDKLNEKYGYYKSLNPAYFLYVEHKEKNKRIKSFERVNLVDVNNIK<br>DEKSLVKYLIENKKLVEPRVIKKVYKRQVILINDYPYSIVTLDSNKLMDF<br>ENLKPLFLENKYEKILKNVIKFLEDNQGKSEENYKFIYLKKKDRYEKNET<br>LESVKDRYNLEFNEMYDKFLEKLDSKDYKNYMNNKKYQELLDVKEKFI<br>KLNLFDKAFTLKSFLDLFNRKTMADFSKVGLTKYLGKIQKISSNVLSKNE<br>LYLLEESVTGLFVKKIKL (SEQ ID NO: 32) |
| EcCas9<br>*Enterococcus cecorum*<br>NCBI<br>Reference<br>Sequence:<br>WP_047338<br>501.1<br>Wild type | RRKQRIQILQELLGEEVLKTDPGFFHRMKESRYVVEDKRTLDGKQVELP<br>YALFVDKDYTDKEYYKQFPTINHLIVYLMTTSDTPDIRLVYLALHYYMK<br>NRGNFLHSGDINNVKDINDILEQLDNVLETFLDGWNLKLKSYVEDIKNIY<br>NRDLGRGERKKAFVNTLGAKTKAEKAFCSLISGGSTNLAELFDDSSLKEI<br>ETPKIEFASSSLEDKIDGIQEALEDRFAVIEAAKRLYDWKTLTDILGDSSS<br>LAEARVNSYQMHHEQLLELKSLVKEYLDRKVFQEVFVSLNVANNYPAY<br>IGHTKINGKKKELEVKRTKRNDFYSYVKKQVIEPIKKKVSDEAVLTKLSE<br>IESLIEVDKYLPLQVNSDNGVIPYQVKLNELTRIFDNLENRIPVLRENRDK<br>IIKTFKFRIPYYVGSLNGVVKNGKCTNWMVRKEEGKIYPWNFEDKVDLE<br>ASAEQFIRRMTNKCTYLVNEDVLPKYSLLYSKYLVLSELNNLRIDGRPLD<br>VKIKQDIYENVFKKNRKVTLKKIKKYLLKEGIITDDDELSGLADDVKSSL<br>TAYRDFKEKLGHLDLSEAQMENIILNITLFGDDKKLLKKRLAALYPFIDD<br>KSLNRIATLNYRDWGRLSERFLSGITSVDQETGELRTIIQCMYETQANLM<br>QLLAEPYHFVEAIEKENPKVDLESISYRIVNDLYVSPAVKRQIWQTLLVIK<br>DIKQVMKHDPERIFIEMAREKQESKKTKSRKQVLSEVYKKAKEYEHLFE<br>KLNSLTEEQLRSKKIYLYFTQLGKCMYSGEPIDFENLVSANSNYDIDHIYP<br>QSKTIDDSFNNIVLVKKSLNAYKSNHYPIDKNIRDNEKVKTLWNTLVSK<br>GLITKEKYERURSTPFSDEELAGFIARQLVETRQSTKAVAEILSNWFPESE<br>IVYSKAKNVSNFRQDFEILKVRELNDCHHAHDAYLNIVVGNAYHTKFTN<br>SPYRFIKNKANQEYNLRKLLQKVNKIESNGVVAWVGQSENNPGTIATVK<br>KVIRRNTVLISRMVKEVDGQLFDLTLMKKGKGQVPIKSSDERLTDISKY<br>GGYNKATGAYFTFVKSKKRGKVVRSFEYVPLHLSKQFENNNELLKEYIE<br>KDRGLTDVEILIPKVLINSLFRYNGSLVRITGRGDTRLLLVHEQPLYVSNS<br>FVQQLKSVSSYKLKKSENDNAKLTKTATEKLSNIDELYDGLLRKLDLPIY<br>SYWFSSIKEYLVESRTKYIKLSIEEKALVIFEILHLFQSDAQVPNLKILGLS<br>TKPSRlRIQKNLKDTDKMSIIHQSPSGIFEHEIELTSL (SEQ ID NO: 33) |
| AhCas9<br>*Anaerostipes hadrus*<br>NCBI<br>Reference<br>Sequence:<br>WP_044924<br>278.1<br>Wild type | MQNGFLGITVSSEQVGWAVTNPKYELERASRKDLWGVRLFDKAETAED<br>RRMFRTNRRLNQRKKNRIHYLRDIFHEEVNQKDPNFFQQLDESNFCEDD<br>RTVEFNFDTNLYKNQFPTVYHLRKYLMETKDKPIARLVYLAFSKFMKN<br>RGHFLYKGNLGEVMDFENSMKGFCESLEKFNIDFPTLSDEQVKEVRDIL<br>CDHKIAKTVKKKNIITITKVKSKTAKAWIGLFCGCSVPVKVLFQDIDEEIV<br>TDPEKISFEDASYDDYIANIEKGVGIYYEAIVSAKMLFDWSILNEILGDHQ<br>LLSDAMIAEYNKHHDDLKRLQKIIKGTGSRELYQDIFINDVSGNYVCYV<br>GHAKTMSSADQKQFYTFLKNRLKNVNGISSEDAEWIDTEIKNGTLLPKQ<br>TKRDNSVIPHQLQLREFELILDNMQEMYPFLKENREKLLKIFNFVIPYYV<br>GPLKGVVRKGESTNWMVPKKDGVIHPWNFDEMVDKEASAECFISRMT<br>GNCSYLFNEKVLPKNSLLYETFEVLNELNPLKINGEPISVELKQRIYEQLF<br>LTGKKVTKKSLTKYLIKNGYDKDIELSGIDNEFHSNLKSHIDFEDYDNLS<br>DEEVEQIILRITVFEDKQLLKDYLNREFVKLSEDERKQICSLSYKGWGNL<br>SEMLLNGITVTDSNGVEVSVMDMLWNTNLNLMQILSKKYGYKAEIEHY<br>NKEHEKTIYNREDLMDYLNIPPAQRRKVNQLITIVKSLKKTYGVPNKIFF<br>KISREHQDDPKRTSSRKEQLKYLYKSLKSEDEKHLMKELDELNDHELSN<br>DKVYLYFLQKGRCIYSGKKLNSRLRKSNYQNDIDYIYPLSAVNDRSMN<br>NKVLTGIQENRADKYTYFPVDSEIQKKMKGFWMELVLQGFMTKEKYFR<br>LSRENDFSKSELVSFIEREISDNQQSGRMIASVLQYYFPESKIVFVKEKLIS<br>SFKRDFHLISSYGHNHLQAAKDAYITIVVGNVYHTKFTMDPAIYFKNHK<br>RKDYDLNRLFLENISRDGQIAWESGPYGSIQTVRKEYAQNHIAVTKRVV<br>EVKGGLFKQMPLKKGHEYPLKTNDPRFGNIAQYGGYTNVTGSYFVLV<br>ESMEKGKKRISLEYVPVYLHERLEDDPGHKLLKEYLVDHRKLNHPKILL<br>AKVRKNSLLKIDGFYYRLNGRSGNALILTNAVELIMDDWQTKTANKISG<br>YMKRRAIDKKARVYQNEFHIQELEQLYDFYLDKLKNGVYKNRKNNQA<br>ELIHNEKEQFMELKTEDQCVLLTEIKKLFVCSPMQADLTLIGGSKHTGMI<br>AMSSNVTKADFAVIAEDPLGLRNKVIYSHKGEK (SEQ ID NO: 34) |
| KvCas9<br>*Kandleria vitulina*<br>NCBI<br>Reference<br>Sequence: | MSQNNNKIYNIGLDIGDASVGWAVVDEHYNLLKRHGKHMWGSRLFTQ<br>ANTAVERRSSRSTRRRYNKRRERIRLLREIMEDMVLDVDPTFFIRLANVS<br>FLDQEDKKDYLKENYHSNYNLFIDKDFNDKTYYDKYPTIYHLRKHLCES<br>KEKEDPRLIYLALHHIVKYRGNFLYEGQKFSMDVSNIEDKMIDVLRQFN<br>EINLFEYVEDRKKIDEVLNVLKEPLSKKHKAEKAFALFDTTKDNKAAYK<br>ELCAALAGNKFNVTKMLKEAELHDEDEKDISFKFSDATFDDAFVEKQPL |

| Description | Sequence |
|---|---|
| WP_031589 969.1 Wild type | LGDCVEFIDLLHDIYSWVELQNILGSAHTSEPSISAAMIQRYEDHKNDLK LLKDVIRKYLPKKYFEVFRDEKSKKNNYCNYINHPSKTPVDEFYKYIKK LIEKIDDPDVKTILNKIELESFMLKQNSRTNGAVPYQMQLDELNKILENQ SVYYSDLKDNEDKIRSILTFRIPYYFGPLNITKDRQFDWIIKKEGKENERIL PWNANEIVDVDKTADEFIKRMRNFCTYFPDEPVMAKNSLTVSKYEVLN EINKLRINDHLIKRDMKDKMLHTLFMDHKSISANAMKKWLVKNQYFSN TDDIKIEGFQKENACSTSLTPWIDFTKIFGKINESNYDFIEKIIYDVTVFED KKILRRRLKKEYDLDEEKIKKILKLKYSGWSRLSKKLLSGIKTKYKDSTR TPETVLEVMERTNMNLMQVINDEKLGFKKTIDDANSTSVSGKFSYAEVQ ELAGSPAIKRGIWQALLIVDEIKKIMKHEPAHVYIEFARNEDEKERKDSF VNQMLKLYKDYDFEDETEKEANKHLKGEDAKSKIRSERLKLYYTQMG KCMYTGKSLDIDRLDTYQVDHIVPQSLLKDDSIDNKVLVLSSENQRKLD DLVIPSSIRNKMYGFWEKLFNNKIISPKKFYSLIKTEFNEKDQERFINRQIV ETRQITKHVAQIIDNHYENTKVVTVRADLSHQFRERYHIYKNRDINDFHH AHDAYIATILGTYIGHRFESLDAKYIYGEYKRIFRNQKNKGKEMKKNND GFILNSMRNIYADKDTGEIVWDPNYIDRIKKCFYYKDCFVTKKLEENNG TFFNVTVLPNDTNSDKDNTLATVPVNKYRSNVNKYGGFSGVNSFIVAIK GKKKKGKKVIEVNKLTGIPLMYKNADEEIKINYLKQAEDLEEVQIGKEIL KNQLIEKDGGLYYIVAPTEIINAKQLILNESQTKLVCEIYKAMKYKNYDN LDSEKIIDLYRLLINKMELYYPEYRKQLVKKFEDRYEQLKVISIEEKCNII KQILATLHCNSSIGKIMYSDFKISTTIGRLNGRTISLDDISFIAESPTGMYSK KYKL (SEQ ID NO: 35) |
| EfCas9 Enterococcus faecalis NCBI Reference Sequence: WP_016631 044.1 Wild type | MRLFEEGHTAEDRRLKRTARRRIRRRNRLRYLQAFFEEAMTDLDENFF ARLQESFLVPEDKKWHRHPIFAKLEDEVAYHETYPTIYHLRKKLADSSE QADLRLIYLALAHIVKYRGHFLIEGKLSTENTSVKDQFQQFMVIYNQTFV NGESRLVSAPLPESVLIEEELTEKASRTKKSEKVLQQFPQEKANGLFGQF LKLMVGNKADFKKVFGLEEEAKITYASESYEEDLEGILAKVGDEYSDVF LAAKNVYDAVELSTILADSDKKSHAKLSSSMIVRFTEHQEDLKKFKRFIR ENCPDEYDNLFKNEQKDGYAGYIAHAGKVSQLKFYQYVKKIIQDIAGAE YFLEKIAQENFLRKQRTFDNGVIPHQIHLAELQAIIHRQAAYYPFLKENQE KIEQLVTFRIPYYVGPLSKGDASTFAWLKRQSEEPIRPWNLQETVDLDQS ATAFIERMTNFDTYLPSEKVLPKHSLLYEKFMVFNELTKISYTDDRGIKA NFSGKEKEKIFDYLFKTRRKVKKKDIIQFYRNEYNTEIVTLSGLEEDQFN ASFSTYQDLLKCGLTRAELDHPDNAEKLEDIIKILTIFEDRQRIRTQLSTFK GQFSAEVLKKLERKHYTGWGRLSKKLINGIYDKESGKTILDYLVKDDGV SKHYNRNFMQLINDSQLSFKNAIQKAQSSEHEETLSETVNELAGSPAIKK GIYQSLKIVDELVAIMGYAPKRIVVEMARENQTTSTGKRRSIQRLKIVEK AMAEIGSNLLKEQPTTNEQLRDTRLFLYYMQNGKDMYTGDELSLHRLS HYDIDHIIPQSFMKDDSLDNLVLVGSTENRGKSDDVPSKEVVKDMKAY WEKLYAAGLISQRKFQRLTKGEQGGLTLEDKAHFIQRQLVETRQITKNV AGILDQRYNAKSKEKKVQIITLKASLTSQFRSIFGLYKVREVNDYHHGQD AYLNCVVATTLLKVYPNLAPEFVYGEYPKFQTFKENKATAKAIIYTNLL RFFTEDEPRFTKDGEILWSNSYLKTIKKELNYHQMNIVKKVEVQKGGFS KESIKPKGPSNKLIPVKNGLDPQKYGGFDSPVVAYTVLFTHEKGKKPLIK QEILGITIMEKTRFEQNPILFLEEKGFLRPRVLMKLPKYTLYEFPEGRRRL LASAKEAQKGNQMVLPEHLLTLLYHAKQCLLPNQSESLAYVEQHQPEF QEILERVVDFAEVHTLAKSKVQQIVKLFEANQTADVKEIAASFIQLMQFN AMGAPSTFKFFQKDIERARYTSIKEIFDATIIYQSPTGLYETRRKVVD (SEQ ID NO: 36) |
| Staphylococcus aureus Cas9 | KRNYILGLDIGITSVGYGIIDYETRDVIDAGVRLFKEANVENNEGRRSKR GARRLKRRRRHRIQRVKKLLFDYNLLTDHSELSGINPYEARVKGLSQKL SEEEFSAALLHLAKRRGVHNVEVEEDTGNELSTKEQISRNSKALEEKY VAELQLERLKKDGEVRGSINRFKTSDYVKEAKQLLKVQKAYHQLDQSFI DTYIDLLETRRTYYEGPGEGSPFGWKDIKEWYEMLMGHCTYFPEELRSV KYAYNADLYNALNDLNNLVITRDENEKLEYYEKFQIIENVFKQKKKPTL KQIAKEILVNEEDIKGYRVTSTGKPEFTNLKVYHDIKDITARKEIIENAEL LDQIAKILTIYQSSEDIQEELTNLNSELTQEEIEQISNLKGYTGTHNLSLKAI NLILDELWHTNDNQIAIFNRLKLVPKKVDLSQQKEIPTTLVDDFILSPVVK RSFIQSIKVINAIIKKYGLPNDIIIELAREKNSKDAQKMINEMQKRNRQTN ERIEEIIRTTGKENAKYLIEKIKLHDMQEGKCLYSLEAIPLEDLLNNPFNY EVDHIIPRSVSFDNSFNNKVLVKQEENSKKGNRTPFQYLSSSDSKISYETF KKHILNLAKGKGRISKTKKEYLLEERDINRFSVQKDFINRNLVDTRYATR GLMNLLRSYFRVNNLDVKVKSINGGFTSFLRRKWKFKKERNKGYKHHA EDALIIANADFIFKEWKKLDKAKKVMENQMFEEKQAESMPEIETEQEYK EIFITPHQIKHIKDFKDYKYSHRVDKKPNRELINDTLYSTRKDDKGNTLIV NNLNGLYDKDNDKLKKLINKSPEKLLMYHHDPQTYQKLKLIMEQYGDE KNPLYKYYEETGNYLTKYSKKDNGPVIKKIKYYGNKLNAHLDITDDYP NSRNKVVKLSLKPYRFDVYLDNGVYKFVTVKNLDVIKKENYYEVNSKC YEEAKKLKKISNQAEFIASFYNNDLIKINGELYRVIGVNNDLLNRIEVNMI DITYREYLENMNDKRPPRIIKTIASKTQSIKKYSTDILGNLYEVKSKKHPQ IIKKG (SEQ ID NO: 37) |
| Geobacillus therrnodenit | MKYKIGLDIGITSIGWAVINLDIPRIEDLGVRIFDRAENPKTGESLALPRRL ARSARRRLRRRRKHRLERIRRLFVREGILTKEELNKLFEKKHEIDVWQLRV |

| Description | Sequence |
|---|---|
| *rificans* Cas9 | EALDRKLNNDELARILLHLAKRRGFRSNRKSERTNKENSTMLKHIEENQ<br>SILSSYRTVAEMVVKDPKFSLHKRNKEDNYTNTVARDDLEREIKLIFAKQ<br>REYGNIVCTEAFEHEYISIWASQRPFASKDDIEKKVGFCTFEPKEKRAPK<br>ATYTFQSFTVWEHINKLRLVSPGGIRALTDDERRLIYKQAFHKNKITFHD<br>VRTLLNLPDDTRFKGLLYDRNTTLKENEKVRFLELGAYHKIRKAIDSVY<br>GKGAAKSFRPIDFDTFGYALTMFKDDTDIRSYLRNEYEQNGKRMENLA<br>DKVYDEELIEELLNLSFSKFGHLSLKALRNILPYMEQGEVYSTACERAGY<br>TFTGPKKKQKTVLLPNIPPIANPVVMRALTQARKVVNAIIKKYGSPVSIHI<br>ELARELSQSFDERRKMQKEQEGNRKKNETAIRQLVEYGLTLNPTGLDIV<br>KFKLWSEQNGKCAYSLQPIEIERLLEPGYTEVDHVIPYSRSLDDSYTNKV<br>LVLTKENREKGNRTPAEYLGLGSERWQQFETFVLTNKQFSKKKRDRLLR<br>LHYDENEENEFKNRNLNDTRYISRFLANFIREHLKFADSDDKQKVYTVN<br>GRITAHLRSRWNFNKNREESNLHHAVDAAIVACTTPSDIARVTAFYQRR<br>EQNKELSKKTDPQFPQPWPHFADELQARLSKNPKESIKALNLGNYDNEK<br>LESLQPVFVSRMPKRSITGAAHQETLRRYIGIDERSGKIQTVVKKKLSEIQ<br>LDKTGHFPMYGKESDPRTYEAIRQRLLEHNNDPKKAFQEPLYKPKKNGE<br>LGPIIRTIKIIDTTNQVIPLNDGKTVAYNSNIVRVDVFEKDGKYYCVPIYTI<br>DMMKGILPNKAIEPNKPYSEWKEMTEDYTFRFSLYPNDLIRIEFPREKTIK<br>TAVGEEIKIKDLFAYYQTIDSSNGGLSLVSHDNNFSLRSIGSRTLKRFEKY<br>QVDVLGNIYKVRGEKRVGVASSSHSKAGETIRPL<br>(SEQ ID NO: 38) |
| ScCas9<br>*S. canis*<br>1375 AA<br>159.2 kDa | MEKKYSIGLDIGTNSVGWAVITDDYKVPSKKFKVLGNTNRKSIKKNLM<br>GALLFDSGETAEATRLKRTARRRYTRRKNRIRYLQEIFANEMAKLDDSF<br>FQRLEESFLVEEDKKNERHPIFGNLADEVAYHRNYPTIYHLRKKLADSPE<br>KADLRLIYLALAHIIKFRGHFLIEGKLNAENSDVAKLFYQLIQTYNQLFEE<br>SPLDEIEVDAKGILSARLSKSKRLEKLIAVFPNEKKNGLFGNIIALALGLTP<br>NFKSNFDLTEDAKLQLSKDTYDDDLDELLGQIGDQYADLFSAAKNLSDA<br>ILLSDILRSNSEVTKAPLSASMVKRYDEHHQDLALLKTLVRQQFPEKYAE<br>IPKDDTKNGYAGYVGIGIKHRKRTTKLATQEEFYKFIKPILEKMDGAEEL<br>LAKLNRDDLLRKQRTFDNGSIPHQIHLKELHAILRRQEEFYPFLKENREKI<br>EKILTFRIPYYVGPLARGNSRFAWLTRKSEEAITPWNFEEVVDKGASAQS<br>FIERMTNFDEQLPNKKVLPKHSLLYEYFTVYNELTKVKYVTERMRKPEF<br>LSGEQKKAIVDLLFKTNRKVTVKQLKEDYFKKIECFDSVEIIGVEDRFNA<br>SLGTYHDLLKIIKDKDFLDNEENEDILEDIVLTLTLFEDREMIEERLKTYA<br>HLFDDKVMKQLKRRHYTGWGRLSRKMINGIRDKQSGKTILDFLKSDGF<br>SNRNFMQLIHDDSLTFKEEIEKAQVSGQGDSLHEQIADLAGSPAIKKGIL<br>QTVKIVDELVKVMGHKPENIVIEMARENQTTTKGLQQSRERKKRIEEGIK<br>ELESQILKENPVENTQLQNEKLYLYYLQNGRDMYVDQELDINRLSDYDV<br>DHIVPQSFIKDDSIDNKVLTRSVENRGKSDNVPSEEVVKKMKNYWRQLL<br>NAKLITQRKFDNLTKAERGGLSEADKAGFIKRQLVETRQITKHVARILDS<br>RMNTKRDKNDKPIREVKVITLKSKLVSDFRKDFQLYKVRDINNYHHAH<br>DAYLNAVVGTALIKKYPKLESEFVYGDYKVYDVRKMIAKSEQEIGKAT<br>AKRFFYSNIMNFFKTEVKLANGEIRKRPLIETNGETGEVVWNKEKDFAT<br>VRKVLAMPQVNIVKKTEVQTGGFSKESILSKRESAKLIPRKKGWDTRKY<br>GGFGSPTVAYSILVVAKVEKGKAKKLKSVKVLVGITIMEKGSYEKDPIGF<br>LEAKGYKDIKKELIFKLPKYSLFELENGRRRMLASATELQKANELVLPQ<br>HLVRLLYYTQNISATTGSNNLGYIEQHREEFKEIFEKIIDFSEKYILKNKV<br>NSNLKSSFDEQFAVSDSILLSNSFVSLLKYTSFGASGGFTFLDLDVKQGRL<br>RYQTVTEVLDATLIYQSITGLYETRTDLSQLGGD(SEQ ID NO: 39) |

The prime editors described herein may include any of the above Cas9 ortholog sequences, or any variants thereof having at least 80%, at least 85%, at least 90%, at least 95%, or at least 99% sequence identity thereto.

The napDNAbp may include any suitable homologs and/or orthologs or naturally occurring enzymes, such as, Cas9. Cas9 homologs and/or orthologs have been described in various species, including, but not limited to, *S. pyogenes* and *S. thermophilus*. Preferably, the Cas moiety is configured (e.g, mutagenized, recombinantly engineered, or otherwise obtained from nature) as a nickase, i.e., capable of cleaving only a single strand of the target doubpdditional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase. In some embodiments, the Cas9 protein comprises an amino acid sequence that is at least 80% identical to the amino acid sequence of a Cas9 protein as provided by any one of the variants of Table 3. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the Cas9 orthologs in the above tables.

C. Dead Cas9 Variant

In certain embodiments, the prime editors described herein may include a dead Cas9, e.g., dead SpCas9, which has no nuclease activity due to one or more mutations that inactive both nuclease domains of Cas9, namely the RuvC domain (which cleaves the non-protospacer DNA strand) and HNN domain (which cleaves the protospacer DNA strand). The nuclease inactivation may be due to one or mutations that result in one or more substitutions and/or deletions in the amino acid sequence of the encoded protein, or any variants thereof having at least 80%, at least 85%, at least 90%, at least 95%, or at least 99% sequence identity thereto.

As used herein, the term "dCas9" refers to a nuclease-inactive Cas9 or nuclease-dead Cas9, or a functional fragment thereof, and embraces any naturally occurring dCas9 from any organism, any naturally-occurring dCas9 equivalent or functional fragment thereof, any dCas9 homolog, ortholog, or paralog from any organism, and any mutant or variant of a dCas9, naturally-occurring or engineered. The term dCas9 is not meant to be particularly limiting and may be referred to as a "dCas9 or equivalent." Exemplary dCas9 proteins and method for making dCas9 proteins are further described herein and/or are described in the art and are incorporated herein by reference.

In other embodiments, dCas9 corresponds to, or comprises in part or in whole, a Cas9 amino acid sequence having one or more mutations that inactivate the Cas9 nuclease activity. In other embodiments, Cas9 variants having mutations other than D10A and H840A are provided which may result in the full or partial inactivate of the endogenous Cas9 nuclease activity (e.g., nCas9 or dCas9, respectively). Such mutations, by way of example, include other amino acid substitutions at D10 and H820, or other substitutions within the nuclease domains of Cas9 (e.g., substitutions in the HNH nuclease subdomain and/or the RuvC1 subdomain) with reference to a wild type sequence such as Cas9 from Streptococcus pyogenes (NCBI Reference Sequence: NC_017053.1). In some embodiments, variants or homologues of Cas9 (e.g., variants of Cas9 from Streptococcus pyogenes (NCBI Reference Sequence: NC_017053.1 (SEQ ID NO: 20))) are provided which are at least about 70% identical, at least about 80% identical, at least about 90% identical, at least about 95% identical, at least about 98% identical, at least about 99% identical, at least about 99.5% identical, or at least about 99.9% identical to NCBI Reference Sequence: NC_017053.1. In some embodiments, variants of dCas9 (e.g., variants of NCBI Reference Sequence: NC_017053.1 (SEQ ID NO: 20)) are provided having amino acid sequences which are shorter, or longer than NC_017053.1 (SEQ ID NO: 20) by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In one embodiment, the dead Cas9 may be based on the canonical SpCas9 sequence of Q99ZW2 and may have the following sequence, which comprises a D10X and an H810X, wherein X may be any amino acid, substitutions (underlined and bolded), or a variant be variant of SEQ ID NO: 40 having at least 80%, at least 85%, at least 90%, at least 95%, or at least 99% sequence identity thereto.

In one embodiment, the dead Cas9 may be based on the canonical SpCas9 sequence of Q99ZW2 and may have the following sequence, which comprises a D10A and an H810A substitutions (underlined and bolded), or be a variant of SEQ ID NO: 41 having at least 80%, at least 85%, at least 90%, at least 95%, or at least 99% sequence identity thereto.

| Description | Sequence | SEQ ID NO: |
|---|---|---|
| dead Cas9 or dCas9 Streptococcus pyogenes Q99ZW2 Cas9 with D10X and H810X Where "X" is any amino acid | MDKKYSIGLXIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINTASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVEISGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKVM GRHKPENIVIEMARENQTTQKGQKNSRERMKRIEEGIKE LGSQILKEHPVENTQLQNEKLYLYYLQNGRDMYVDQEL DINRLSDYDVDXIVPQSFLKDDSIDNKVLTRSDKNRGKS DNVPSEEVVKKMKNYWRQLLNAKLITQRKFDNLTKAER GGLSELDKAGFIKRQLVETRQITKHVAQILDSRMNTKYD ENDKLIREVKVITLKSKLVSDFRKDFQFYKVREINTNYHH AHDAYLNAVVGTALIKKYPKLESEFVYGDYKVYDVRK MIAKSEQEIGKATAKYFFYSNIMNFFKTEITLANGEIRKRP LIETNGETGEIVWDKGRDFATVRKVLSMPQVNIVKKTEV QTGGFSKESILPKRNSDKLIARKKDWDPKKYGGFDSPTV AYSVLVVAKVEKGKSKKLKSVKELLGITIMERSSFEKNPI DPFLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGD | SEQ ID NO: 40 |
| dead Cas9 or dCas9 Streptococcus pyogenes Q99ZW2 | MDKKYSIGLAIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE | SEQ ID NO: 41 |

| Description | Sequence | SEQ ID NO: |
|---|---|---|
| Cas9 with D10A and H810A | NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVETSGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDAIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | |

D. Cas9 Nickase Variant

In one embodiment, the prime editors described herein comprise a Cas9 nickase. The term "Cas9 nickase" of "nCas9" refers to a variant of Cas9 which is capable of introducing a single-strand break in a double strand DNA molecule target. In some embodiments, the Cas9 nickase comprises only a single functioning nuclease domain. The wild type Cas9 (e.g., the canonical SpCas9) comprises two separate nuclease domains, namely, the RuvC domain (which cleaves the non-protospacer DNA strand) and HNH domain (which cleaves the protospacer DNA strand). In one embodiment, the Cas9 nickase comprises a mutation in the RuvC domain which inactivates the RuvC nuclease activity. For example, mutations in aspartate (D) 10, histidine (H) 983, aspartate (D) 986, or glutamate (E) 762, have been reported as loss-of-function mutations of the RuvC nuclease domain and the creation of a functional Cas9 nickase (e.g., Nishimasu et al., "Crystal structure of Cas9 in complex with guide RNA and target DNA," Cell 156(5), 935-949, which is incorporated herein by reference). Thus, nickase mutations in the RuvC domain could include D10X, H983X, D986X, or E762X, wherein X is any amino acid other than the wild type amino acid. In certain embodiments, the nickase could be D10A, of H983A, or D986A, or E762A, or a combination thereof.

In various embodiments, the Cas9 nickase can having a mutation in the RuvC nuclease domain and have one of the following amino acid sequences, or a variant thereof having an amino acid sequence that has at least 80%, at least 85%, at least 90%, at least 95%, or at least 99% sequence identity thereto.

| Sequence | Description | SEQ ID NO: |
|---|---|---|
| Cas9 nickase<br>*Streptococcus pyogenes*<br>Q99ZW2<br>Cas9 with D10X,<br>wherein X is any alternate amino acid | MDKKYSIGLXIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL | SEQ ID NO:<br>42 |

| Sequence | Description | SEQ ID NO: |
|---|---|---|
| | DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | |
| Cas9 nickase<br>Streptococcus<br>pyogenes<br>Q99ZW2<br>Cas9 with<br>E762X,<br>wherein X is<br>any alternate<br>amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIXMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | SEQ ID NO: 43 |
| Cas9 nickase<br>Streptococcus<br>pyogenes<br>Q99ZW2<br>Cas9 with<br>H983X,<br>wherein X is<br>any alternate<br>amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHX<br>AHDAYLNAVVGTALIKKYPKLESEFVYGDYKVYDVRK | SEQ ID NO: 44 |

| Sequence | Description | SEQ ID NO: |
|---|---|---|
| | MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | |
| Cas9 nickase<br>*Streptococcus<br>pyogenes*<br>Q99ZW2<br>Cas9 with<br>D986X,<br>wherein X is<br>any alternate<br>amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHXAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | SEQ ID NO: 45 |
| Cas9 nickase<br>*Streptococcus<br>pyogenes*<br>Q99ZW2<br>Cas9 with<br>D10A | MDKKYSIGLAIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG | SEQ ID NO: 46 |

| Sequence | Description | SEQ ID NO: |
|---|---|---|
| | ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | |
| Cas9 nickase<br>*Streptococcus*<br>*pyogenes*<br>Q99ZW2<br>Cas9 with<br>E762A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIAMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | SEQ ID NO:<br>47 |
| Cas9 nickase<br>*Streptococcus*<br>*pyogenes*<br>Q99ZW2<br>Cas9 with<br>H983A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVETSGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHA<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | SEQ ID NO:<br>48 |

| Sequence | Description | SEQ ID NO: |
|---|---|---|
| Cas9 nickase *Streptococcus pyogenes* Q99ZW2 Cas9 with D986A | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINTASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS AS MIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVETSGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKM GRHKPENIVIEMARENQTTQKGQKNSRERMKRIEEGIKE LGSQILKEHPVENTQLQNEKLYLYYLQNGRDMYVDQEL DINRLSDYDVDHIVPQSFLKDDSIDNKVLTRSDKNRGKS DNVPSEEVVKKMKNYWRQLLNAKLITQRKFDNLTKAER GGLSELDKAGFIKRQLVETRQITKHVAQILDSRMNTKYD ENDKLIREVKVITLKSKLVSDFRKDFQFYKVREINTNYHH AHAAYLNAVVGTALIKKYPKLESEFVYGDYKVYDVRK MIAKSEQEIGKATAKYFFYSNIMNFFKTEITLANGEIRKRP LIETNGETGEIVWDKGRDFATVRKVLSMPQVNIVKKTEV QTGGFSKESILPKRNSDKLIARKKDWDPKKYGGFDSPTV AYSVLVVAKVEKGKSKKLKSVKELLGITIMERSSFEKNPI DFLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGD | SEQ ID NO: 49 |

In another embodiment, the Cas9 nickase comprises a mutation in the HNH domain which inactivates the HNH nuclease activity. For example, mutations in histidine (H) 840 or asparagine (R) 863 have been reported as loss-of-function mutations of the HNH nuclease domain and the creation of a functional Cas9 nickase (e.g., Nishimasu et al., "Crystal structure of Cas9 in complex with guide RNA and target DNA," *Cell* 156(5), 935-949, which is incorporated herein by reference). Thus, nickase mutations in the HNH domain could include H840X and R863X, wherein X is any amino acid other than the wild type amino acid. In certain embodiments, the nickase could be H840A or R863A or a combination thereof.

In various embodiments, the Cas9 nickase can have a mutation in the HNH nuclease domain and have one of the following amino acid sequences, or a variant thereof having an amino acid sequence that has at least 80%, at least 85%, at least 90%, at least 95%, or at least 99% sequence identity thereto.

| Sequence | Description | SEQ ID NO: |
|---|---|---|
| Cas9 nickase *Streptococcus pyogenes* Q99ZW2 Cas9 with H840X, wherein X is any alternate amino acid | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINTASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVEISGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKM GRHKPENIVIEMARENQTTQKGQKNSRERMKRIEEGIKE LGSQILKEHPVENTQLQNEKLYLYYLQNGRDMYVDQEL DINRLSDYDVDXIVPQSFLKDDSIDNKVLTRSDKNRGKS DNVPSEEVVKKMKNYWRQLLNAKLITQRKFDNLTKAER | SEQ ID NO: 50 |

| Sequence | Description | SEQ ID NO: |
|---|---|---|
| | GGLSELDKAGFIKRQLVETRQITKHVAQILDSRMNTKYD<br>ENDKLIREVKVITLKSKLVSDFRKDFQFYKVREININYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | |
| Cas9 nickase<br>Streptococcus<br>pyogenes<br>Q99ZW2<br>Cas9 with<br>H840A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVETSGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDAIVPQSFLKDDSIDNKVLTRSDKNRGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREININYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV<br>QTGGFSKESILPKRNSDKLIARKKDWDPKKYGGFDSPTV<br>AYSVLVVAKVEKGKSKKLKSVKELLGITIMERSSFEKNPI<br>DFLEAKGYKEVKKDLIIKLPKYSLFELENGRKRMLASAG<br>ELQKGNELALPSKYVNFLYLASHYEKLKGSPEDNEQKQL<br>FVEQHKHYLDEIIEQISEFSKRVILADANLDKVLSAYNKH<br>RDKPIREQAENIIHLFTLTNLGAPAAFKYFDTTIDRKRYTS<br>TKEVLDATLIHQSITGLYETRIDLSQLGGD | SEQ ID NO:<br>51 |
| Cas9 nickase<br>Streptococcus<br>pyogenes<br>Q99ZW2<br>Cas9 with<br>R863X,<br>wherein X is<br>any alternate<br>amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINTASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRE<br>DLLRKQRTFDNGSIPHQIHLGELHAILRRQEDFYPFLKDN<br>REKIEKILTFRIPYYVGPLARGNSRFAWMTRKSEETITPW<br>NFEEVVDKGASAQSFIERMTNFDKNLPNEKVLPKHSLLY<br>EYFTVYNELTKVKYVTEGMRKPAFLSGEQKKAIVDLLFK<br>TNRKVTVKQLKEDYFKKIECFDSVEISGVEDRFNASLGT<br>YHDLLKIIKDKDFLDNEENEDILEDIVLTLTLFEDREMIEE<br>RLKTYAHLFDDKVMKQLKRRRYTGWGRLSRKLINGIRD<br>KQSGKTILDFLKSDGFANRNFMQLIHDDSLTFKEDIQKAQ<br>VSGQGDSLHEHIANLAGSPAIKKGILQTVKVVDELVKVM<br>GRHKPENIVIEMARENQTTQKGQKNSRERMKRIEEGIKE<br>LGSQILKEHPVENTQLQNEKLYLYYLQNGRDMYVDQEL<br>DINRLSDYDVDHIVPQSFLKDDSIDNKVLTRSDKNXGKS<br>DNVPSEEVVKKMKNYWRQLLNAKLITQRKFDNLTKAER<br>GGLSELDKAGFIKRQLVETRQITKHVAQILDSRMNTKYD<br>ENDKLIREVKVITLKSKLVSDFRKDFQFYKVREINTNYHH<br>AHDAYLNAVVGTALIKKYPKLESEFVYGDYKVYDVRK<br>MIAKSEQEIGKATAKYFFYSNIMNFFKTEITLANGEIRKRP<br>LIETNGETGEIVWDKGRDFATVRKVLSMPQVNIVKKTEV | SEQ ID NO:<br>52 |

| Sequence | Description | SEQ ID NO: |
|---|---|---|
| | QTGGFSKESILPKRNSDKLIARKKDWDPKKYGGFDSPTV AYSVLVVAKVEKGKSKKLKSVKELLGITIMERSSFEKNPI DFLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGD | |
| Cas9 nickase *Streptococcus pyogenes* Q99ZW2 Cas9 with R863A | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINTASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRE DLLRKQRTFDNGSIPHQIHLGELHAILRRQEDFYPFLKDN REKIEKILTFRIPYYVGPLARGNSRFAWMTRKSEETITPW NFEEVVDKGASAQSFIERMTNFDKNLPNEKVLPKHSLLY EYFTVYNELTKVKYVTEGMRKPAFLSGEQKKAIVDLLFK TNRKVTVKQLKEDYFKKIECFDSVETSGVEDRFNASLGT YHDLLKIIKDKDFLDNEENEDILEDIVLTLTLFEDREMIEE RLKTYAHLFDDKVMKQLKRRRYTGWGRLSRKLINGIRD KQSGKTILDFLKSDGFANRNFMQLIHDDSLTFKEDIQKAQ VSGQGDSLHEHIANLAGSPAIKKGILQTVKVVDELVKVM GRHKPENIVIEMARENQTTQKGQKNSRERMKRIEEGIKE LGSQILKEHPVENTQLQNEKLYLYYLQNGRDMYVDQEL DINRLSDYDVDHIVPQSFLKDDSIDNKVLTRSDKNAGKS DNVPSEEVVKKMKNYWRQLLNAKLITQRKFDNLTKAER GGLSELDKAGFIKRQLVETRQITKHVAQILDSRMNTKYD ENDKLIREVKVITLKSKLVSDFRKDFQFYKVREINTNYHH AHDAYLNAVVGTALIKKYPKLESEFVYGDYKVYDVRK MIAKSEQEIGKATAKYFFYSNIMNFFKTEITLANGEIRKRP LIETNGETGEIVWDKGRDFATVRKVLSMPQVNIVKKTEV QTGGFSKESILPKRNSDKLIARKKDWDPKKYGGFDSPTV AYSVLVVAKVEKGKSKKLKSVKELLGITIMERSSFEKNPI DFLEAKGYKEVKKDLIIKLPKYSLFELENGRKRMLASAG ELQKGNELALPSKYVNFLYLASHYEKLKGSPEDNEQKQL FVEQHKHYLDEIIEQISEFSKRVILADANLDKVLSAYNKH RDKPIREQAENIIHLFTLTNLGAPAAFKYFDTTIDRKRYTS TKEVLDATLIHQSITGLYETRIDLSQLGGD | SEQ ID NO: 53 |

In some embodiments, the N-terminal methionine is removed from a Cas9 nickase, or from any Cas9 variant, ortholog, or equivalent disclosed or contemplated herein. For example, methionine-minus Cas9 nickases include the following sequences, or a variant thereof having an amino acid sequence that has at least 80%, at least 85%, at least 90%, at least 95%, or at least 99% sequence identity thereto.

| Description | Sequence |
|---|---|
| Cas9 nickase (Met minus) *Streptococcus pyogenes* Q99ZW2 Cas 9 with H840X, wherein X is any alternate amino acid | DKKYSIGLDIGTNSVGWAVITDEYKVPSKKFKVLGNTDRHSIKKNLIG ALLFDSGETAEATRLKRTARRRYTRRKNRICYLQEIFSNEMAKVDDSF FHRLEESFLVEEDKKHERHPIFGNIVDEVAYHEKYPTIYHLRKKLVDST DKADLRLIYLALAHMIKFRGHFLIEGDLNPDNSDVDKLFIQLVQTYNQ LFEENPINASGVDAKAILSARLSKSRRLENLIAQLPGEKKNGLFGNLIAL SLGLTPNFKSNFDLAEDAKLQLSKDTYDDDLDNLLAQIGDQYADLFLA AKNLSDAILLSDILRVNTEITKAPLSASMIKRYDEHHQDLTLLKALVRQ QLPEKYKEIFFDQSKNGYAGYIDGGASQEEFYKFIKPILEKMDGTEELL VKLNREDLLRKQRTFDNGSIPHQIHLGELHAILRRQEDFYPFLKDNREK QSIEKILTFRIPYYVGPLARGNSRFAWMTRKSEETITPWNFEEVVDKGASA FIERMTNFDKNLPNEKVLPKHSLLYEYFTVYNELTKVKYVTEGMR KPAFLSGEQKKAIVDLLFKTNRKVTVKQLKEDYFKKIECFDSVETSGVE DRFNASLGTYHDLLKIIKDKDFLDNEENEDILEDIVLTLTLFEDREMIEE RLKTYAHLFDDKVMKQLKRRRYTGWGRLSRKLINGIRDKQSGKTILD FLKSDGFANRNFMQLIHDDSLTFKEDIQKAQVSGQGDSLHEHIANLAG SPAIKKGILQTVKVVDELVKVMGRHKPENIVIEMARENQTTQKGQKNS RERMKRIEEGIKELGSQILKEHPVENTQLQNEKLYLYYLQNGRDMYV DQELDINRLSDYDVDXIVPQSFLKDDSIDNKVLTRSDKNRGKSDNVPS EEVVKKMKNYWRQLLNAKLITQRKFDNLTKAERGGLSELDKAGFIKR |

| Description | Sequence |
|---|---|
| | QLVETRQITKHVAQILDSRMNTKYDENDKLIREVKVITLKSKLVSDFR
KDFQFYKVREINNYHHAHDAYLNAVVGTALIKKYPKLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILP
KRNSDKLIARKKDWDPKKYGGFDSPTVAYSVLVVAKVEKGKSKKLK
SVKELLGITIMERSSFEKNPIDFLEAKGYKEVKKDLIIKLPKYSLFELEN
GRKRMLASAGELQKGNELALPSKYVNFLYLASHYEKLKGSPEDNEQK
QLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD (SEQ ID NO: 54) |
| Cas9 nickase (Met minus) *Streptococcus pyogenes* Q99ZW2 Cas9 with H840A | DKKYSIGLDIGTNSVGWAVITDEYKVPSKKFKVLGNTDRHSIKKNLIG
ALLFDS GETAEATRLKRTARRRYTRRKNRICYLQEIFSNEMAKVDDSF
FHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQ
LFEENPINASGVDAKAILSARLSKSRRLENLIAQLPGEKKNGLFGNLIAL
SLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQ
QLPEKYKEIFFDQSKNGYAGYIDGGASQEEFYKFIKPILEKMDGTEELL
VKLNREDLLRKQRTFDNGSIPHQIHLGELHAILRRQEDFYPFLKDNREK
IEKILTFRIPYYVGPLARGNSRFAWMTRKSEETITPWNFEEVVDKGASA
QSFIERMTNFDKNLPNEKVLPKHSLLYEYFTVYNELTKVKYVTEGMR
KPAFLSGEQKKAIVDLLFKTNRKVTVKQLKEDYFKKIECFDSVETSGVE
DRFNASLGTYHDLLKIIKDKDFLDNEENEDILEDIVLTLTLFEDREMIEE
RLKTYAHLFDDKVMKQLKRRRYTGWGRLSRKLINGIRDKQSGKTILD
FLKSDGFANRNFMQLIHDDSLTFKEDIQKAQVSGQGDSLHEHIANLAG
SPAIKKGILQTVKVVDELVKVMGRHKPENIVIEMARENQTTQKGQKNS
RERMKRIEEGIKELGSQILKEHPVENTQLQNEKLYLYYLQNGRDMYV
DQELDINRLSDYDVDAIVPQSFLKDDSIDNKVLTRSDKNRGKSDNVPS
EEVVKKMKNYWRQLLNAKLITQRKFDNLTKAERGGLSELDKAGFIKR
QLVETRQITKHVAQILDSRMNTKYDENDKLIREVKVITLKSKLVSDFR
KDFQFYKVREINNYHHAHDAYLNAVVGTALIKKYPKLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILP
KRNSDKLIARKKDWDPKKYGGFDSPTVAYSVLVVAKVEKGKSKKLK
SVKELLGITIMERSSFEKNPIDFLEAKGYKEVKKDLIIKLPKYSLFELEN
GRKRMLASAGELQKGNELALPSKYVNFLYLASHYEKLKGSPEDNEQK
QLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD (SEQ ID NO: 55) |
| Cas9 nickase (Met minus) *Streptococcus pyogenes* Q99ZW2 Cas9 with R863X, wherein X is any alternate amino acid | DKKYSIGLDIGTNSVGWAVITDEYKVPSKKFKVLGNTDRHSIKKNLIG
ALLFDSGETAEATRLKRTARRRYTRRKNRICYLQEIFSNEMAKVDDSF
FHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQ
LFEENPINASGVDAKAILSARLSKSRRLENLIAQLPGEKKNGLFGNLIAL
SLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQ
QLPEKYKEIFFDQSKNGYAGYIDGGASQEEFYKFIKPILEKMDGTEELL
VKLNREDLLRKQRTFDNGS1PHQIHLGELHAILRRQEDFYPFLKDNREK
IEKILTFRIPYYVGPLARGNSRFAWMTRKSEETITPWNFEEVVDKGASA
QSFIERMTNFDKNLPNEKVLPKHSLLYEYFTVYNELTKVKYVTEGMR
KPAFLSGEQKKAIVDLLFKTNRKVTVKQLKEDYFKKIECFDSVETSGVE
DRFNASLGTYHDLLKIIKDKDFLDNEENEDILEDIVLTLTLFEDREMIEE
RLKTYAHLFDDKVMKQLKRRRYTGWGRLSRKLINGIRDKQSGKTILD
FLKSDGFANRNFMQLIHDDSLTFKEDIQKAQVSGQGDSLHEHIANLAG
SPAIKKGILQTVKVVDELVKVMGRHKPENIVIEMARENQTTQKGQKNS
RERMKRIEEGIKELGSQILKEHPVENTQLQNEKLYLYYLQNGRDMYV
DQELDINRLSDYDVDHIVPQSFLKDDSIDNKVLTRSDKNXGKSDNVPS
EEVVKKMKNYWRQLLNAKLITQRKFDNLTKAERGGLSELDKAGFIKR
QLVETRQITKHVAQILDSRMNTKYDENDKLIREVKVITLKSKLVSDFR
KDFQFYKVREINNYHHAHDAYLNAVVGTALIKKYPKLESEFVYGDYK
VYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILP
KRNSDKLIARKKDWDPKKYGGFDSPTVAYSVLVVAKVEKGKSKKLK
SVKELLGITIMERSSFEKNPIDFLEAKGYKEVKKDLIIKLPKYSLFELEN
GRKRMLASAGELQKGNELALPSKYVNFLYLASHYEKLKGSPEDNEQK
QLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD(SEQ ID NO: 56) |
| Cas9 nickase (Met minus) *Streptococcus pyogenes* | DKKYSIGLDIGTNSVGWAVITDEYKVPSKKFKVLGNTDRHSIKKNLIG
ALLFDSGETAEATRLKRTARRRYTRRKNRICYLQEIFSNEMAKVDDSF
FHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQ |

| Description | Sequence |
|---|---|
| Q99ZW2 Cas9 with R863A | LFEENPINASGVDAKAILSARLSKSRRLENLIAQLPGEKKNGLFGNLIAL SLGLTPNFKSNFDLAEDAKLQLSKDTYDDDLDNLLAQIGDQYADLFLA AKNLSDAILLSDILRVNTEITKAPLSASMIKRYDEHHQDLTLLKALVRQ QLPEKYKEIFFDQSKNGYAGYIDGGASQEEFYKFIKPILEKMDGTEELL VKLNREDLLRKQRTFDNGSIPHQIHLGELHAILRRQEDFYPFLKDNREK IEKILTFRIPYYVGPLARGNSRFAWMTRKSEETITPWNFEEVVDKGASA QSFIERMTNFDKNLPNEKVLPKHSLLYEYFTVYNELTKVKYVTEGMR KPAFLSGEQKKAIVDLLFKTNRKVTVKQLKEDYFKKIECFDSVETSGVE DRFNASLGTYHDLLKIIKDKDFLDNEENEDILEDIVLTLTLFEDREMIEE RLKTYAHLFDDKVMKQLKRRRYTGWGRLSRKLINGIRDKQSGKTILD FLKSDGFANRNFMQLIHDDSLTFKEDIQKAQVSGQGDSLHEHIANLAG SPAIKKGILQTVKVVDELVKVMGRHKPENIVIEMARENQTTQKGQKNS RERMKRIEEGIKELGSQILKEHPVENTQLQNEKLYLYYLQNGRDMYV DQELDINRLSDYDVDHIVPQSFLKDDSIDNKVLTRSDKNAGKSDNVPS EEVVKKMKNYWRQLLNAKLITQRKFDNLTKAERGGLSELDKAGFIKR QLVETRQITKHVAQILDSRMNTKYDENDKLIREVKVITLKSKLVSDFR KDFQFYKVREINNYHHAHDAYLNAVVGTALIKKYPKLESEFVYGDYK VYDVRKMIAKSEQEIGKATAKYFFYSNIMNFFKTEITLANGEIRKRPLIE TNGETGEIVWDKGRDFATVRKVLSMPQVNIVKKTEVQTGGFSKESILP KRNSDKLIARKKDWDPKKYGGFDSPTVAYSVLVVAKVEKGKSKKLK SVKELLGITIMERSSFEKNPIDFLEAKGYKEVKKDLIIKLPKYSLFELEN GRKRMLASAGELQKGNELALPSKYVNFLYLASHYEKLKGSPEDNEQK QLFVEQHKHYLDEIIEQISEFSKRVILADANLDKVLSAYNKHRDKPIRE QAENIIHLFTLTNLGAPAAFKYFDTTIDRKRYTSTKEVLDATLIHQSITG LYETRIDLSQLGGD (SEQ ID NO: 57) |

E. Other Cas9 Variants

Besides dead Cas9 and Cas9 nickase variants, the Cas9 proteins used herein may also include other "Cas9 variants" having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 protein, including any wild type Cas9, or mutant Cas9 (e.g., a dead Cas9 or Cas9 nickase), or fragment Cas9, or circular permutant Cas9, or other variant of Cas9 disclosed herein or known in the art. In some embodiments, a Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a reference Cas9. In some embodiments, the Cas9 variant comprises a fragment of a reference Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SEQ ID NO: 18).

In some embodiments, the disclosure also may utilize Cas9 fragments which retain their functionality and which are fragments of any herein disclosed Cas9 protein. In some embodiments, the Cas9 fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In various embodiments, the prime editors disclosed herein may comprise one of the Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 variants.

F. Small-Sized Cas9 Variants

In some embodiments, the prime editors contemplated herein can include a Cas9 protein that is of smaller molecular weight than the canonical SpCas9 sequence. In some embodiments, the smaller-sized Cas9 variants may facilitate delivery to cells, e.g., by an expression vector, nanoparticle, or other means of delivery. In certain embodiments, the smaller-sized Cas9 variants can include enzymes categorized as type II enzymes of the Class 2 CRISPR-Cas systems. In some embodiments, the smaller-sized Cas9 variants can include enzymes categorized as type V enzymes of the Class 2 CRISPR-Cas systems. In other embodiments, the smaller-sized Cas9 variants can include enzymes categorized as type VI enzymes of the Class 2 CRISPR-Cas systems.

The canonical SpCas9 protein is 1368 amino acids in length and has a predicted molecular weight of 158 kilodaltons. The term "small-sized Cas9 variant", as used herein, refers to any Cas9 variant—naturally occurring, engineered, or otherwise—that is less than at least 1300 amino acids, or at least less than 1290 amino acids, or than less than 1280 amino acids, or less than 1270 amino acid, or less than 1260 amino acid, or less than 1250 amino acids, or less than 1240 amino acids, or less than 1230 amino acids, or less than 1220 amino acids, or less than 1210 amino acids, or less than 1200 amino acids, or less than 1190 amino acids, or less than 1180 amino acids, or less than 1170 amino acids, or less than 1160 amino acids, or less than 1150 amino acids, or less than 1140 amino acids, or less than 1130 amino acids, or less than 1120 amino acids, or less than 1110 amino acids, or less than 1100 amino acids, or less than 1050 amino acids, or less than 1000 amino acids, or less than 950 amino acids, or less than 900 amino acids, or less than 850 amino acids, or less than 800 amino acids, or less than 750 amino acids, or less than 700 amino acids, or less than 650 amino acids, or less than 600 amino acids, or less than 550 amino acids, or less than 500 amino acids, but at least larger than about 400 amino acids and retaining the required functions of the Cas9 protein. The Cas9 variants can include those categorized as type II, type V, or type VI enzymes of the Class 2 CRISPR-Cas system.

In various embodiments, the prime editors disclosed herein may comprise one of the small-sized Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference small-sized Cas9 protein.

| Description | Sequence | SEQ ID NO: |
| --- | --- | --- |
| SaCas9 Staphylococcus aureus 1053 AA 123 kDa | MGKRNYILGLDIGITSVGYGIIDYETRDVIDAGVRLFKEA NVENNEGRRSKRGARRLKRRRRHRIQRVKKLLFDYNLL TDHSELSGINPYEARVKGLSQKLSEEEFSAALLHLAKRRG VHNVNEVEEDTGNELSTKEQISRNSKALEEKYVAELQLE RLKKDGEVRGSINRFKTSDYVKEAKQLLKVQKAYHQLD QSFIDTYIDLLETRRTYYEGPGEGSPFGWKDIKEWYEML MGHCTYFPEELRSVKYAYNADLYNALNDLNNLVITRDE NEKLEYYEKFQIIENVFKQKKKPTLKQIAKEILVNEEDIK GYRVTSTGKPEFTNLKVYHDIKDITARKEIIENAELLDQIA KILTIYQSSEDIQEELTNLNSELTQEEIEQISNLKGYTGTHN LSLKAINLILDELWHTNDNQIAIFNRLKLVPKKVDLSQQK EIPTTLVDDFILSPVVKRSFIQSIKVINAIIKKYGLPNDIIIEL AREKNSKDAQKMINEMQKRNRQTNERIEEIIRTTGKENA KYLIEKIKLHDMQEGKCLYSLEAIPLEDLLNNPFNYEVDH IIPRSVSFDNSFNNKVLVKQEENSKKGNRTPFQYLSSSDS KISYETFKKHILNLAKGKGRISKTKKEYLLEERDINRFSV QKDFINRNLVDTRYATRGLMNLLRSYFRVNNLDVKVKSI NGGFTSFLRRKWKFKKERNKGYKHHAEDALIIANADFIF KEWKKLDKAKKVMENQMFEEKQAESMPEIETEQEYKEI FITPHQIKHIKDFKDYKYSHRVDKKPNRKLINDTLYSTRK DDKGNTLIVNNLNGLYDKDNDKLKKLINKSPEKLLMYH HDPQTYQKLKLIMEQYGDEKNPLYKYYEETGNYLTKYS KKDNGPVIKKIKYYGNKLNAHLDITDDYPNSRNKVVKLS LKPYRFDVYLDNGVYKFVTVKNLDVIKKENYYEVNSKC YEEAKKLKKISNQAEFIASFYKNDLIKINGELYRVIGVNN DLLNRIEVNMIDITYREYLENMNDKRPPHIIKTIASKTQSI KKYSTDILGNLYEVKSKKHPQIIKK | SEQ ID NO: 58 |
| NmeCas9 N. meningitidis 1083 AA 124.5 kDa | MAAFKPNSINYILGLDIGIASVGWAMVEIDEEENPIRLIDL GVRVFERAEVPKTGDSLAMARRLARSVRRLTRRRAHRL LRTRRLLKREGVLQAANFDENGLIKSLPNTPWQLRAAAL DRKLTPLEWSAVLLHLIKHRGYLSQRKNEGETADKELGA LLKGVAGNAHALQTGDFRTPAELALNKFEKESGHIRNQR SDYSHTFSRKDLQAELILLFEKQKEFGNPHVSGGLKEGIE TLLMTQRPALSGDAVQKMLGHCTFEPAEPKAAKNTYTA ERFIWLTKLNNLRILEQGSERPLTDTERATLMDEPYRKSK LTYAQARKLLGLEDTAFFKGLRYGKDNAEASTLMEMKA YHAISRALEKEGLKDKKSPLNLSPELQDEIGTAFSLFKTD EDITGRLKDRIQPEILEALLKHISFDKFVQISLKALRRIVPL MEQGKRYDEACAEIYGDHYGKKNTEEKIYLPPIPADEIR NPVVLRALSQARKVINGVVRRYGSPARIHIETAREVGKSF KDRKEIEKRQEENRKDREKAAAKFREYFPNFVGEPKSKD ILKLRLYEQQHGKCLYSGKEINLGRLNEKGYVEIDAALPF SRTWDDSFNNKVLVLGSENQNKGNQTPYEYFNGKDNSR EWQEFKARVETSRFPRSKKQRILLQKFDEDGFKERNLND TRYVNRFLCQFVADRMRLTGKGKKRVFASNGQITNLLR GFWGLRKVRAENDRHHALDAVVVACSTVAMQQKITRF VRYKEMNAFDGKTIDKETGEVLHQKTHFPQPWEFFAQE VMIRVFGKPDGKPEFEEADTLEKLRTLLAEKLSSRPEAVH EYVTPLFVSRAPNRKMSGQGHMETVKSAKRLDEGVSVL RVPLTQLKLKDLEKMVNREREPKLYEALKARLEAHKDD PAKAFAEPFYKYDKAGNRTQQVKAVRVEQVQKTGVWV RNHNGIADNATMVRVDVFEKGDKYYLVPIYSWQVAKGI LPDRAVVQGKDEEDWQLIDDSFNFKFSLHPNDLVEVITK KARMFGYFASCHRGTGNINIRIHDLDHKIGKNGILEGIGV KTALSFQKYQIDELGKEIRPCRLKKRPPVR | SEQ ID NO: 59 |
| CjCas9 C. jejuni 984 AA 114.9 kDa | MARILAFDIGISSIGWAFSENDELKDCGVRIFTKVENPKT GESLALPRRLARSARKRLARRKARLNHLKHLIANEFKLN YEDYQSFDESLAKAYKGSLISPYELRFRALNELLSKQDFA RVILHIAKRRGYDDIKNSDDKEKGAILKAIKQNEEKLAN YQSVGEYLYKEYFQKFKENSKEFTNVRNKKESYERCIAQ SFLKDELKLIFKKQREFGFSFSKKFEEEVLSVAFYKRALK DFSHLVGNCSFFTDEKRAPKNSPLAFMFVALTRIINLLNN LKNTEGILYTKDDLNALLNEVLKNGTLTYKQTKKLLGLS DDYEFKGEKGTYFIEFKKYKEFIKALGEHNLSQDDLNEIA | SEQ ID NO: 60 |

| Description | Sequence | SEQ ID NO: |
|---|---|---|
| | KDITLIKDEIKLKKALAKYDLNQNQIDSLSKLEFKDHLNIS<br>FKALKLVTPLMLEGKKYDEACNELNLKVAINEDKKDFLP<br>AFNETYYKDEVTNPVVLRAIKEYRKVLNALLKKYGKVH<br>KINIELAREVGKNHSQRAKIEKEQNENYKAKKDAELECE<br>KLGLKINSKNILKLRLFKEQKEFCAYSGEKIKISDLQDEK<br>MLEIDHIYPYSRSFDDSYMNKVLVFTKQNQEKLNQTPFE<br>AFGNDSAKWQKIEVLAKNLPTKKQKRILDKNYKDKEQK<br>NFKDRNLNDTRYIARLVLNYTKDYLDFLPLSDDENTKLN<br>DTQKGSKVHVEAKSGMLTSALRHTWGFSAKDRNNHLH<br>HAIDAVIIAYANNSIVKAFSDFKKEQESNSAELYAKKISEL<br>DYKNKRKFFEPFSGFRQKVLDKIDEIFVSKPERKKPSGAL<br>HEETFRKEEEFYQSYGGKEGVLKALELGKIRKVNGKIVK<br>NGDMFRVDIFKHKKTNKFYAVPIYTMDFALKVLPNKAV<br>ARSKKGEIKDWILMDENYEFCFSLYKDSLILIQTKDMQEP<br>EFVYYNAFTSSTVSLIVSKHDNKFETLSKNQKILFKNANE<br>KEVIAKSIGIQNLKVFEKYIVSALGEVTKAEFRQREDFKK | |
| GeoCas9<br>G. stearothermo-<br>philus<br>1087 AA<br>127 kDa | MRYKIGLDIGITSVGWAVMNLDIPRIEDLGVRIFDRAENP<br>QTGESLALPRRLARSARRRLRRRKHRLERIRRLVIREGILT<br>KEELDKLFEEKHEIDVWQLRVEALDRKLNNDELARVLL<br>HLAKRRGFKSNRKSERSNKENSTMLKHIEENRAILSSYRT<br>VGEMIVKDPKFALHKRNKGENYTNTIARDDLEREIRLIFS<br>KQREFGNMSCTEEFENEYITIWASQRPVASKDDIEKKVGF<br>CTFEPKEKRAPKATYTFQSFIAWEHINKLRLISPSGARGLT<br>DEERRLLYEQAFQKNKITYHDIRTLLHLPDDTYFKGIVYD<br>RGESRKQNENIRFLELDAYHQIRKAVDKVYGKGKSSSFL<br>PIDFDTFGYALTLFKDDADIHSYLRNEYEQNGKRMPNLA<br>NKVYDNELIEELLNLSFTKFGHLSLKALRSILPYMEQGEV<br>YSSACERAGYTFTGPKKKQKTMLLPNIPPIANPVVMRAL<br>TQARKVVNAIIKKYGSPVSIHIELARDLSQTFDERRKTKK<br>EQDENRKKNETAIRQLMEYGLTLNPTGHDIVKFKLWSEQ<br>NGRCAYSLQPIEIERLLEPGYVEVDHVIPYSRSLDDSYTN<br>KVLVLTRENREKGNRIPAEYLGVGTERWQQFETFVLTNK<br>QFSKKKRDRLLRLHYDENEETEFKNRNLNDTRYISRFFA<br>NFIREHLKFAESDDKQKVYTVNGRVTAHLRSRWEFNKN<br>REESDLHHAVDAVIVACTTPSDIAKVTAFYQRREQNKEL<br>AKKTEPHFPQPWPHFADELRARLSKHPKESIKALNLGNY<br>DDQKLESLQPVFVSRMPKRSVTGAAHQETLRRYVGIDER<br>SGKIQTVVKTKLSEIKLDASGHFPMYGKESDPRTYEAIRQ<br>RLLEHNNDPKKAFQEPLYKPKKNGEPGPVIRTVKIIDTKN<br>QVIPLNDGKTVAYNSNIVRVDVFEKDGKYYCVPVYTMD<br>IMKGILPNKAIEPNKPYSEWKEMTEDYTFRFSLYPNDLIRI<br>ELPREKTVKTAAGEEINVKDVFVYYKTIDSANGGLELISH<br>DHRFSLRGVGSRTLKRFEKYQVDVLGNIYKVRGEKRVG<br>LASSAHSKPGKTIRPLQSTRD | SEQ ID NO: 61 |
| LbaCas12a<br>L. bacterium<br>1228 AA<br>143.9 kDa | MSKLEKFTNCYSLSKTLRFKAIPVGKTQENIDNKRLLVED<br>EKRAEDYKGVKKLLDRYYLSFINDVLHSIKLKNLNNYIS<br>LFRKKTRTEKENKELENLEINLRKEIAKAFKGNEGYKSLF<br>KKDIIETILPEFLDDKDEIALVNSFNGFTTAFTGFFDNREN<br>MFSEEAKSTSIAFRCINENLTRYISNMDIFEKVDAIFDKHE<br>VQEIKEKILNSDYDVEDFFEGEFFNFVLTQEGIDVYNAIIG<br>GFVTESGEKIKGLNEYINLYNQKTKQKLPKFKPLYKQVL<br>SDRESLSFYGEGYTSDEEVLEVFRNTLNKNSEIFSSIKKLE<br>KLFKNFDEYSSAGIFVKNGPAISTISKDIFGEWNVIRDKW<br>NAEYDDIHLKKKAVVTEKYEDDRRKSFKKIGSFSLEQLQ<br>EYADADLSVVEKLKEIIIQKVDEIYKVYGSSEKLFDADFV<br>LEKSLKKNDAVVAIMKDLLDSVKSFENYIKAFFGEGKET<br>NRDESFYGDFVLAYDILLKVDHIYDAIRNYVTQKPYSKD<br>KFKLYFQNPQFMGGWDKDKETDYRATILRYGSKYYLAI<br>MDKKYAKCLQKIDKDDVNGNYEKINYKLLPGPNKMLPK<br>VFFSKKWMAYYNPSEDIQKIYKNGTFKKGDMFNLNDCH<br>KLIDFFKDSISRYPKWSNAYDFNFSETEKYKDIAGFYREV<br>EEQGYKVSFESASKKEVDKLVEEGKLYMFQIYNKDFSDK<br>SHGTPNLHTMYFKLLFDENNHGQIRLSGGAELFMRRAS<br>L KKEELVVHPANSPIANKNPDNPKKTTTLSYDVYKDKRFS<br>EDQYELHIPIAINKCPKNIFKINTEVRVLLKHDDNPYVIGI<br>DRGERNLLYIVVVDGKGNIVEQYSLNEIINNFNGIRIKTD<br>YHSLLDKKEKERFEARQNWTSIENIKELKAGYISQVVHKI<br>CELVEKYDAVIALEDLNSGFKNSRVKVEKQVYQKFEKM<br>LIDKLNYMVDKKSNPCATGGALKGYQITNKFESFKSMST<br>QNGFIFYIPAWLTSKIDPSTGFVNLLKTKYTSIADSKKFISS<br>FDRIMYVPEEDLFEFALDYKNFSRTDADYIKKWKLYSYG<br>NRIRIFRNPKKNNVFDWEEVCLTSAYKELFNKYGINYQQ<br>GDIRALLCEQSDKAFYSSFMALMSLMLQMRNSITGRTDV<br>DFLISPVKNSDGIFYDSRNYEAQENAILPKNADANGAYNI | SEQ ID NO: 62 |

| Description | Sequence | SEQ ID NO: |
|---|---|---|
| | ARKVLWAIGQFKKAEDEKLDKVKIAISNKEWLEYAQTSVKH | |
| BhCas12b<br>B. hisashii<br>1108 AA<br>130.4 kDa | MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM | SEQ ID NO:<br>63 |

G. Cas9 Equivalents

In some embodiments, the prime editors described herein can include any Cas9 equivalent. As used herein, the term "Cas9 equivalent" is a broad term that encompasses any napDNAbp protein that serves the same function as Cas9 in the present prime editors despite that its amino acid primary sequence and/or its three-dimensional structure may be different and/or unrelated from an evolutionary standpoint. Thus, while Cas9 equivalents include any Cas9 ortholog, homolog, mutant, or variant described or embraced herein that are evolutionarily related, the Cas9 equivalents also embrace proteins that may have evolved through convergent evolution processes to have the same or similar function as Cas9, but which do not necessarily have any similarity with regard to amino acid sequence and/or three dimensional structure. The prime editors described here embrace any Cas9 equivalent that would provide the same or similar function as Cas9 despite that the Cas9 equivalent may be based on a protein that arose through convergent evolution. For instance, if Cas9 refers to a type II enzyme of the CRISPR-Cas system, a Cas9 equivalent can refer to a type V or type VI enzyme of the CRISPR-Cas system.

For example, Cas12e (CasX) is a Cas9 equivalent that reportedly has the same function as Cas9 but which evolved through convergent evolution. Thus, the Cas12e (CasX) protein described in Liu et al., "CasX enzymes comprises a distinct family of RNA-guided genome editors," Nature, 2019, Vol. 566: 218-223, is contemplated to be used with the prime editors described herein. In addition, any variant or modification of Cas12e (CasX) is conceivable and within the scope of the present disclosure.

Cas9 is a bacterial enzyme that evolved in a wide variety of species. However, the Cas9 equivalents contemplated herein may also be obtained from archaea, which constitute a domain and kingdom of single-celled prokaryotic microbes different from bacteria.

In some embodiments, Cas9 equivalents may refer to Cas12e (CasX) or Cas12d (CasY), which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-Cas12e and CRISPR-Cas12d, which are among the most compact systems yet discovered. In some embodiments, Cas9 refers to Cas12e, or a variant of Cas12e. In some embodiments, Cas9 refers to a Cas12d, or a variant of Cas12d. It should be appreciated that other RNA-guided DNA binding proteins may be used as a nucleic acid programmable DNA binding protein (napDNAbp), and are within the scope of this disclosure. Also see Liu et al., "CasX enzymes comprises a distinct family of RNA-guided genome editors," Nature, 2019, Vol. 566: 218-223. Any of these Cas9 equivalents are contemplated.

In some embodiments, the Cas9 equivalent comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12e (CasX) or Cas12d (CasY) protein. In some embodiments, the napDNAbp is a naturally-occurring Cas12e (CasX) or Cas12d (CasY) protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein.

In various embodiments, the nucleic acid programmable DNA binding proteins include, without limitation, Cas9 (e.g., dCas9 and nCas9), Cas12e (CasX), Cas12d (CasY), Cas12a (Cpf1), Cas12b1 (C2c1), Cas13a (C2c2), Cas12c (C2c3), Argonaute, and Cas12b1. One example of a nucleic acid programmable DNA-binding protein that has different PAM specificity than Cas9 is Clustered Regularly Interspaced Short Palindromic Repeats from *Prevotella* and *Francisella* 1 (i.e, Cas12a (Cpf1)). Similar to Cas9, Cas12a (Cpf1) is also a Class 2 CRISPR effector, but it is a member of type V subgroup of enzymes, rather than the type II subgroup. It has been shown that Cas12a (Cpf1) mediates robust DNA interference with features distinct from Cas9. Cas12a (Cpf1) is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

In still other embodiments, the Cas protein may include any CRISPR associated protein, including but not limited to, Cas12a, Cas12b1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof, and preferably comprising a nickase mutation (e.g., a mutation corresponding to the D10A mutation of the wild type Cas9 polypeptide of SEQ ID NO: 18).

In various other embodiments, the napDNAbp can be any of the following proteins: a Cas9, a Cas12a (Cpf1), a Cas12e (CasX), a Cas12d (CasY), a Cas12b1 (C2c1), a Cas13a (C2c2), a Cas12c (C2c3), a GeoCas9, a CjCas9, a Cas12g, a Cas12h, a Cas12i, a Cas13b, a Cas13c, a Cas13d, a Cas14, a Csn2, an xCas9, an SpCas9-NG, a circularly permuted Cas9, or an Argonaute (Ago) domain, or a variant thereof.

Exemplary Cas9 equivalent protein sequences can include the following:

| Description | Sequence |
|---|---|
| AsCas12a (previously known as Cpf1) *Acidaminococcus* sp. (strain BV3L6) UniProtKB U2UMQ6 | MTQFEGFTNLYQVSKTLRFELIPQGKTLKHIQEQGFIEEDKARNDHYKEL KPIIDRIYKTYADQCLQLVQLDWENLSAAIDSYRKEKTEETRNALIEEQA TYRNAIHDYFIGRTDNLTDAINKRHAEIYKGLFKAELFNGKVLKQLGTV TTTEHENALLRSFDKFTTYFSGFYENRKNVFSAEDISTA1PHRIVQDNFPK FKENCHIFTRLITAVPSLREHFENVKKAIGIFVSTSIEEVFSFPFYNQLLTQ TQIDLYNQLLGGISREAGTEKIKGLNEVLNLAIQKNDETAHIIASLPHRFIP LFKQILSDRNTLSFILEEFKSDEEVIQSFCKYKTLLRNENVLETAEALFNE LNSIDLTHIFISHKKLETISSALCDHWDTLRNALYERRISELTGKITKSAKE KVQRSLKHEDINLQEIISAAGKELSEAFKQKTSEILSHAHAALDQPLPTTL KKQEEKEILKSQLDSLLGLYHLLDWFAVDESNEVDPEFSARLTGIKLEM EPSLSFYNKARNYATKKPYSVEKFKLNFQMPTLASGWDVNKEKNNGAI LFVKNGLYYLGIMPKQKGRYKALSFEPTEKTSEGFDKMYYDYFPDAAK MIPKCSTQLKAVTAHFQTHTTPILLSNNFIEPLEITKEIYDLNNPEKEPKKF QTAYAKKTGDQKGYREALCKWIDFTRDFLSKYTKTTSIDLSSLRPSSQY KDLGEYYAELNPLLYHISFQRIAEKEIMDAVETGKLYLFQIYNKDFAKG HHGKPNLHTLYWTGLFSPENLAKTSIKLNGQAELFYRPKSRMKRMAHR LGEKMLNKKLKDQKTPIPDTLYQELYDYVNHRLSHDLSDEARALLPNVI TKEVSHEIIKDRRFTSDKFFFHVPITLNYQAANSPSKFNQRVNAYLKEHP ETPIIGIDRGERNLIYITVIDSTGKILEQRSLNTIQQFDYQKKLDNREKERV AARQAWSVVGTIKDLKQGYLSQVIHEIVDLMIHYQAVVVLENLNFGFK SKRTGIAEKAVYQQFEKMLIDKLNCLVLKDYPAEKVGGVLNPYQLTDQ FTSFAKMGTQSGFLFYVPAPYTSKIDPLTGFVDPFVWKTIKNHESRKHFL EGFDFLHYDVKTGDFILHFKMNRNLSFQRGLPGFMPAWDIVFEKNETQF DAKGTPFIAGKRIVPVIENHRFTGRYRDLYPANELIALLEEKGIVFRDGSN ILPKLLENDDSHAIDTMVAHRSVLQMRNSNAATGEDYINSPVRDLNGV CFDSRFQNPEWPMDADANGAYHIALKGQLLLNHLKESKDLKLQNGISN QDWLAYIQELRN (SEQ ID NO: 64) |
| AsCas12a nickase (e.g., R1226A) | MTQFEGFTNLYQVSKTLRFELIPQGKTLKHIQEQGFIEEDKARNDHYKEL KPIIDRIYKTYADQCLQLVQLDWENLSAAIDSYRKEKTEETRNALIEEQA TYRNAIHDYFIGRTDNLTDAINKRHAEIYKGLFKAELFNGKVLKQLGTV TTTEHENALLRSFDKFTTYFSGFYENRKNVFSAEDISTAIPHRIVQDNFPK FKENCHIFTRLITAVPSLREHFENVKKAIGIFVSTSIEEVFSFPFYNQLLTQ TQIDLYNQLLGGISREAGTEKIKGLNEVLNLAIQKNDETAHIIASLPHRFIP LFKQILSDRNTLSFILEEFKSDEEVIQSFCKYKTLLRNENVLETAEALFNE LNSIDLTHIFISHKKLETISSALCDHWDTLRNALYERRISELTGKITKSAKE KVQRSLKHEDINLQEIISAAGKELSEAFKQKTSEILSHAHAALDQPLPTTL KKQEEKEILKSQLDSLLGLYHLLDWFAVDESNEVDPEFSARLTGIKLEM EPSLSFYNKARNYATKKPYSVEKFKLNFQMPTLASGWDVNKEKNNGAI LFVKNGLYYLGIMPKQKGRYKALSFEPTEKTSEGFDKMYYDYFPDAAK MIPKCSTQLKAVTAHFQTHTTPILLSNNFIEPLEITKEIYDLNNPEKEPKKF QTAYAKKTGDQKGYREALCKWIDFTRDFLSKYTKTTSIDLSSLRPSSQY KDLGEYYAELNPLLYHISFQRIAEKEIMDAVETGKLYLFQIYNKDFAKG HHGKPNLHTLYWTGLFSPENLAKTSIKLNGQAELFYRPKSRMKRMAHR LGEKMLNKKLKDQKTPIPDTLYQELYDYVNHRLSHDLSDEARALLPNVI TKEVSHEIIKDRRFTSDKFFFHVPITLNYQAANSPSKFNQRVNAYLKEHP ETPIIGIDRGERNLIYITVIDSTGKILEQRSLNTIQQFDYQKKLDNREKERV AARQAWSVVGTIKDLKQGYLSQVIHEIVDLMIHYQAVVVLENLNFGFK |

| Description | Sequence |
| --- | --- |
| | S KRTGIAEKAVYQQFEKMLIDKLNCLVLKDYPAEKVGGVLNPYQLTDQ<br>FTSFAKMGTQSGFLFYVPAPYTSKIDPLTGFVDPFVWKTIKNHESRKHFL<br>EGFDFLHYDVKTGDFILHFKMNRNLSFQRGLPGFMPAWDIVFEKNETQF<br>DAKGTPFIAGKRIVPVIENHRFTGRYRDLYPANELIALLEEKGIVFRDGSN<br>ILPKLLENDDSHAIDTMVAHRSVLQMANSNAATGEDYINSPVRDLNGV<br>CFDSRFQNPEWPMDADANGAYHIALKGQLLLNHLKESKDLKLQNGISN<br>QDWLAYIQELRN (SEQ ID NO: 65) |
| LbCas12a<br>(previously<br>known as<br>Cpf1)<br>Lachnospiraceae<br>bacterium<br>GAM79<br>Ref Seq.<br>WP_119623382.1 | MNYKTGLEDFIGKESLSKTLRNALIPTESTKIHMEEMGVIRDDELRAEKQ<br>QELKEIMDDYYRTFIEEKLGQIQGIQWNSLFQKMEETMEDISVRKDLDKI<br>QNEKRKEICCYFTSDKRFKDLFNAKLITDILPNFIKDNKEYTEEEKAEKE<br>QTRVLFQRFATAFTNYFNQRRNNFSEDNISTAISFRIVNENSEIHLQNMR<br>AFQRIEQQYPEEVCGMEEEYKDMLQEWQMKHIYSVDFYDRELTQPGIE<br>YYNGICGKINEHMNQFCQKNRINKNDFRMKKLHKQILCKKSSYYEIPFR<br>FESDQEVYDALNEFIKTMKKKEIIRRCVHLGQECDDYDLGKIYISSNKYE<br>QISNALYGSWDTIRKCIKEEYMDALPGKGKEEKKEEKAEAAAKKEEYRSIA<br>DIDKIISLYGSEMDRTISAKKCITEICDMAGQISIDPLVCNSDIKLLQNKEK<br>TTEIKTILDSFLHVYQWGQTFIVSDIIEKDSYFYSELEDVLEDFEGITTLYN<br>HVRSYVTQKPYSTVKFKLHFGSPTLANGWSQSKEYDNNAILLMRDQKF<br>YLGIFNVRNKPDKQIIKGHEKEEKGDYKKMIYNLLPGPSKMLPKVFITSR<br>SGQETYKPSKHILDGYNEKRHIKSSPKFDLGYCWDLIDYYKECIHKHPD<br>WKNYDFHFSDTKDYEDISGFYREVEMQGYQIKWTYISADEIQKLDEKG<br>QIFLFQIYNKDFSVHSTGKDNLHTMYLKNLFSEENLKDIVLKLNGEAELF<br>FRKASIKTPIVHKKGSVLVNRSYTQTVGNKEIRVSIPEEYYTEIYNYLNHI<br>GKGKLSSEAQRYLDEGKIKSFTATKDIVKNYRYCCDHYFLHLPITINFKA<br>KSDVAVNERTLAYIAKKEDIHIIGIDRGERNLLYISVVDVHGNIREQRSFN<br>IVNGYDYQQKLKDREKSRDAARKNWEEIEKIKELKEGYLSMVIHYIAQL<br>VVKYNAVVAMEDLNYGFKTGRFKVERQVYQKFETMLIEKLHYLVFKD<br>REVCEEGGVLRGYQLTYIPESLKKVGKQCGFIFYVPAGYTSKIDPTTGFV<br>NLFSFKNLTNRESRQDFVGKFDEIRYDRDKKMFEFSFDYNNYIKKGTILA<br>STKWKVYTNGTRLKRIVVNGKYTSQSMEVELTDAMEKMLQRAGIEYH<br>DGKDLKGQIVEKGIEAEIIDIFRLTVQMRNSRSESEDREYDRLISPVLNDK<br>GEFFDTATADKTLPQDADANGAYCIALKGLYEVKQIKENWKENEQFPR<br>NKLVQDNKTWFDFMQKKRYL (SEQ ID NO: 66) |
| PcCas12a-<br>previously<br>known at<br>Cpf1<br>Prevotella<br>copri<br>Ref Seq.<br>WP_119227726.1 | MAKNFEDFKRLYSLSKTLRFEAKPIGATLDNIVKSGLLDEDEHRAASYV<br>KVKKLIDEYHKVFIDRVLDDGCLPLENKGNNNSLAEYYESYVSRAQDE<br>DAKKKFKEIQQNLRSVIAKKLTEDKAYANLFGNKLIESYKDKEDKKKII<br>DSDLIQFINTAESTQLDSMSQDEAKELVKEFWGFVTYFYGFFDNRKMY<br>TAEEKSTGIAYRLVNENLPKFIDNIEAFNRAITRPEIQENMGVLYSDFSEY<br>LNVESIQEMFQLDYYNMLLTQKQIDVYNAIIGGKTDDEHDVKIKGINEYI<br>NLYNQQHKDDKLPKLKALFKQILSDRNAISWLPEEFNSDQEVLNAIKDC<br>YERLAENVLGDKVLKSLLGSLADYSLDGIFIRNDLQLTDISQKMFGNWG<br>VIQNAIMQNIKRVAPARKHKESEEDYEKRIAGIFKKADSFSISYINDCLNE<br>ADPNNAYFVENYFATFGAVNTPTMQRENLFALVQNAYTEVAALLHSDY<br>PTVKHLAQDKANVSKIKALLDAIKSLQHFVKPLLGKGDESDKDERFYGE<br>LASLWAELDTVTPLYNMIRNYMTRKPYSQKKIKLNFENPQLLGGWDAN<br>KEKDYATIILRRNGLYYLAIMDKDSRKLLGKAMPSDGECYEKMVYKFF<br>KDVTTMIPKCSTQLKDVQAYFKVNTDDYVLNSKAFNKPLTITKEVFDLN<br>NVLYGKYKKFQKGYLTATGDNVGYTHAVNVWIKFCMDFLNSYDSTCI<br>YDFSSLKPESYLSLDAFYQDANLLLYKLSFARASVSYINQLVEEGKMYL<br>FQIYNKDFSEYSKGTPNMHTLYWKALFDERNLADVVYKLNGQAEMFY<br>RKKSIENTHPTHPANHPILNKNKDNKKKESLFDYDLIKDRRYTVDKFMF<br>HVPITMNFKSVGSENINQDVKAYLRHADDMHIIGIDRGERHLLYLVVIDL<br>QGNIKEQYSLNEIVNEYNGNTYHTNYHDLLDVREEERLKARQSWQTIEN<br>IKELKEGYLSQVIHKITQLMVRYHAIVVLEDLSKGFMRSRQKVEKQVYQ<br>KFEKMLIDKLNYLVDKKTDVSTPGGLLNAYQLTCKSDSSQKLGKQSGF<br>LFYIPAWNTSKIDPVTGFVNLLDTHSLNSKEKIKAFFSKFDAIRYNKDKK<br>WFEFNLDYDKFGKKAEDTRTKWTLCTRGMRIDTFRNKEKNSQWDNQE<br>VDLTTEMKSLLEHYYIDIHGNLKDAISAQTDKAFFTGLLHILKLTLQMRN<br>SITGTETDYLVSPVADENGIFYDSRSCGNQLPENADANGAYNIARKGLM<br>LIEQIKNAEDLNNVKFDISNKAWLNFAQQKPYKNG (SEQ ID NO: 67) |
| ErCas12a-<br>previously<br>known at<br>Cpf1<br>Eubacterium<br>rectale<br>Ref Seq.<br>WP_119223642.1 | MFSAKLISDILPEFVIHNNNYSASEKEEKTQVIKLFSRFATSFKDYFKNRA<br>NCFSANDISSSSCHRIVNDNAEIFFSNALVYRRIVKNLSNDDINKISGDMK<br>DSLKEMSLEEIYSYEKYGEFITQEGISFYNDICGKVNLFMNLYCQKNKEN<br>KNLYKLRKLHKQILCIADTSYEVPYKFESDEEVYQSVNGFLDNISSKHIV<br>ERLRKIGENYNGYNLDKIYIVSKFYESVSQKTYRDWETINTALEIHYNNI<br>LPGNGKSKADKVKKAVKNDLQKSITEINELVSNYKLCPDDNIKAETYIH<br>EISHILNNFEAQELKYNPEIHLVESELKASELKNVLDVIMNAFHWCSVFM<br>TEELVDKDNNFYAELEEIYDEIYPVISLYNLVRNYVTQKPYSTKKIKLNF<br>GIPTLADGWSKSKEYSNNAIILMRDNLYYLGIFNAKNKPDKKIIEGNTSE<br>NKGDYKKMIYNLLPGPNKMPKVFLSSKTGVETYKPSAYILEGYKQNKH<br>LKSSKDFDITFCHDLIDYFKNCIAIHPEWKNFGPDFSDTSTYEDISGFYRE<br>VELQGYKIDWTYISEKDIDLLQEKGQLYLFQIYNKDFSKKSSGNDNLHT<br>MYLKNLFSEENLKDIVLKLNGEAEIFFRKSSIKNPIIHKKGSILVNRTYEA<br>EEKDQFGNIQIVRKTIPENIYQELYKYFNDKSDKELSDEAAKLKNVVGH |

| Description | Sequence |
|---|---|
| | HEAATNIVKDYRYTYDKYFLHMPITINFKANKTSFINDRILQYIAKEKDL<br>HVIGIDRGERNLIYVSVIDTCGNIVEQKSFNIVNGYDYQIKLKQQEGARQI<br>ARKEWKEIGKIKEIKEGYLSLVIHEISKMVIKYNAIIAMEDLSYGFKKGRF<br>KVERQVYQKFETMLINKLNYLVFKDISITENGGLLKGYQLTYIPDKLKN<br>VGHQCGCIFYVPAAYTSKIDPTTGFVNIPKFKDLTVDAKREFIKKFDSIRY<br>DSDKNLFCFTFDYNNFITQNTVMSKSSWSVYTYGVRIKRRFVNGRFSNE<br>SDTIDITKDMEKTLEMTDINWRDGHDLRQDIIDYEIVQHIFEIPKLTVQM<br>RNSLSELEDRDYDRLISPVLNENNIFYDSAKAGDALPKDADANGAYCIA<br>LKGLYEIKQITENWKEDGKFSRDKLKISNKDWFDFIQNKRYL (SEQ ID NO: 68) |
| CsCas12a-<br>previously<br>known at<br>Cpf1<br>Clostridium<br>sp. AF34-<br>10BH<br>Ref Seq.<br>WP_118538418.1 | MNYKTGLEDFIGKESLSKTLRNALIPTESTKIHMEEMGVIRDDELRAEKQ<br>QELKEIMDDYYRAFIEEKLGQIQGIQWNSLFQKMEETMEDISVRKDLDKI<br>QNEKRKEICCYFTSDKRFKDLFNAKLITDILPNFIKDNKEYTEEEKAEKE<br>QTRVLFQRFATAFTNYFNQRRNNFSEDNISTAISFRIVNENSEIHLQNMR<br>AFQRIEQQYPEEVCGMEEEYKDMLQEWQMKHIYLVDFYDRVLTQPGIE<br>YYNGICGKINEHMNQFCQKNRINKNDFRMKKLHKQILCKKSSYYEIPFR<br>FESDQEVYDALNEFIKTMKEKEIICRCVHLGQKCDDYDLGKIYISSNKYE<br>QISNALYGSWDTIRKCIKEEYMDALPGKGEKKEEKAEAAAKKEEYRSIA<br>DIDKIISLYGSEMDRTISAKKCITEICDMAGQISTDPLVCNSDIKLLQNKE<br>KTTEIKTILDSFLHVYQWGQTFIVSDIIEKDSYFYSELEDVLEDFEGITTLY<br>NHVRSYVTQKPYSTVKFKLHFGSPTLANGWSQSKEYDNNAILLMRDQK<br>FYLGIFNVRNKPDKQIIKGHEKEEKGDYKKMIYNLLPGPSKMLPKVFITS<br>RSGQETYKPSKHILDGYNEKRHIKSSPKFDLGYCWDLIDYYKECIHKHP<br>DWKNYDFHFSDTKDYEDISGFYREVEMQGYQIKWTYISADEIQKLDEK<br>GQIFLFQIYNKDFSVHSTGKDNLHTMYLKNLFSEENLKDIVLKLNGEAEL<br>FFRKASIKTPVVHKKGSVLVNRSYTQTVGDKEIRVSIPEEYYTEIYNYLN<br>HIGRGKLSTEAQRYLEERKIKSFTATKDIVKNYRYCCDHYFLHLPITINFK<br>AKSDIAVNERTLAYIAKKEDIHIIGIDRGERNLLYISVVDVHGNIREQRSF<br>NIVNGYDQQKLDREKSRDAARKNWEEIEKIKELKEGYLSMVIHYIAQ<br>LVVKYNAVVAMEDLNYGFKTGRFKVERQVYQKFETMLIEKLHYLVFK<br>DREVCEEGGVLRGYQLTYIPESLKKVGKQCGFIFYVPAGYTSKIDPTTGF<br>VNLFSFKNLTNRESRQDFVGKFDEIRYDRDKKMFEFSFDYNNYIKKGTM<br>LASTKWKVYTNGTRLKRIVVNGKYTSQSMEVELTDAMEKMLQRAGIE<br>YHDGKDLKGQIVEKGIEAEIIDIFRLTVQMRNSRSESEDREYDRLISPVLN<br>DKGEFFDTATADKTLPQDADANGAYCIALKGLYEVKQIKENWKENEQF<br>PRNKLVQDNKTWFDFMQKKRYL (SEQ ID NO: 69) |
| BhCas12b<br>Bacillus<br>hisashii<br>Ref Seq.<br>WP_095142515.1 | MATRSFILKIEPNEEVKKGLWKTHEVLNHGIAYYMNILKLIRQEAIYEHH<br>EQDPKNPKKVSKAEIQAELWDFVLKMQKCNSFTHEVDKDEVFNILREL<br>YEELVPSSVEKKGEANQLSNKFLYPLVDPNSQSGKGTASSGRKPRWYNL<br>KIAGDPSWEEEKKKWEEDKKKDPLAKILGKLAEYGLIPLFIPYTDSNEPI<br>VKEIKWMEKSRNQSVRRLDKDMFIQALERFLSWESWNLKVKEEYEKVE<br>KEYKTLEERIKEDIQALKALEQYEKERQEQLLRDTLNTNEYRLSKRGLR<br>GWREIIQKWLKMDENEPSEKYLEVFKDYQRKHPREAGDYSVYEFLSKK<br>ENHHFIWRNHPEYPYLYATFCEIDKKKKDAKQQATFTLADPINHPLWVRF<br>EERSGSNLNKYRILTEQLHTEKLKKKLTVQLDRLIYPTESGGWEEKGKV<br>DIVLLPSRQFYNQIFLDIEEKGKHAFTYKDESIKFPLKGTLGGARVQFDR<br>DHLRRYPHKVESGNVGRIYFNMTVNIEPTESPVSKSLKIHRDDFPKVVNF<br>KPKELTEWIKDSKGKKLKSGIESLEIGLRVMSIDLGQRQAAAASIFEVVD<br>QKPDIEGKLFFPIKGTELYAVHRASFNIKLPGETLVKSREVLRKAREDNL<br>KLMNQKLNFLRNVLHFQQFEDITEREKRVTKWISRQENSDVPLVYQDEL<br>IQIRELMYKPYKDWVAFLKQLHKRLEVEIGKEVKHWRKSLSTDGRKGLY<br>GISLKNIDEIDRTRKFLLRWSLRPTEPGEVRRLEPGQRFAIDQLNHLNALK<br>EDRLKKMANTIIMHALGYCYDVRKKKWQAKNPACQIILFEDLSNYNPY<br>EERSRFENSKLMKWSRREIPRQVALQGEIYGLQVGEVGAQFSSRFHAKT<br>GSPGIRCSVVTKEKLQDNRFFKNLQREGRLTLDKIAVLKEGDLYPDKGG<br>EKFISLSKDRKCVTTHADINAAQNLQKRFWTRTHGFYKVYCKAYQVDG<br>QTVYIPESKDQKQKIIEEFGEGYFILKDGVYEWVNAGKLKIKKGSSKQSS<br>SELVDSDILKDSFDLASELKGEKLMLYRDPSGNVFPSDKWMAAGVFFG<br>KLERILISKLTNQYSISTIEDDSSKQSM (SEQ ID NO: 70) |
| ThCas12b<br>Thermomonas<br>hydrothermalis<br>Ref Seq.<br>WP_072754838 | MSEKTTQRAYTLRLNRASGECAVCQNNSCDCWHDALWATHKAVNRG<br>AKAFGDWLLTLRGGLCHTLVEMEVPAKGNNPPQRPTDQERRDRRVLLA<br>LSWLSVEDEHGAPKEFIVATGRDSADDRAKKVEEKLREILEKRDFQEHEI<br>DAWLQDCGPSLKAHIREDAVWVNRRALFDAAVERIKTLTWEEAWDFL<br>EPFFGTQYFAGIGDGKDKDDAEGPARQGEKAKDLVQKAGQWLSARFGI<br>GTGADFMSMAEAYEKIAKWASQAQNGDNGKATIEKLACALRPSEPPTL<br>DTVLKCISGPGHKSATREYLKTLDKKSTVTQEDLNQLRKLADEDARNC<br>RKKVGKKGKKPWADEVLKDVENSCELTYLQDNSPARHREFSVMLDHA<br>ARRVSMAHSWIKKAEQRRRQFESDAQKLKNLQERAPSAVEWLDRFCES<br>RSMTTGANTGSSGYRIRKRAIEGWSYVVQAWAEASCDTEDKRIAAARKV<br>QADPEIEKFGDIQLFEALAADEAICVWRDQEGTQNPSILIDYVTGKTAEH<br>NQKRFKVPAYRHPDELRHPVFCDPGNSRWSIQFAIHKEIRDRDKGAKQD<br>TRQLQNRHGLKMRLWNGRSMTDVNLHWSSKRLTADLALDQNPNPNPT<br>EVTRADRLGRAASSAFDHVKIKNVFNEKEWNGRLQAPRAELDRIAKLE<br>EQGKTEQAEKLRKRLRWYVSFSPCLSPSGPFIVYAGQHNIQPKRSGQYA |

| Description | Sequence |
|---|---|
| | PHAQANKGRARLAQLILSRLPDLRILSVDLGHRFAAACAVWETLSSDAF<br>RREIQGLNVLAGGSGEGDLFLHVEMTGDDGKRRTVVYRRIGPDQLLDN<br>TPHPAPWARLDRQFLIKLQGEDEGVREASNEELWTVHKLEVEVGRTVP<br>LIDRMVRSGFGKTEKQKERLKKLRELGWISAMPNEPSAETDEKEGEIRSI<br>SRSVDELMSSALGTLRLALKRHGNRARIAFAMTADYKPMPGGQKYYFH<br>EAKEASKNDDETKRRDNQIEFLQDALSLWHDLFSSPDWEDNEAKKLWQ<br>NHIATLPNYQTPEEISAELKRVERNKKRKENRDKLRTAAKALAENDQLR<br>QHLHDTWKERWESDDQQWKERLRSLKDWIFPRGKAEDNPSIRHVGGLS<br>ITRINTISGLYQILKAFKMRPEPDDLRKNIPQKGDDELENFNRRLLEARDR<br>LREQRVKQLASRIIEAALGVGRIKIPKNGKLPKRPRTTVDTPCHAVVIESL<br>KTYRPDDLRTRRENRQLMQWSSAKVRKYLKEGCELYGLHFLEVPANYT<br>SRQCSRTGLPGIRCDDVPTGDFLKAPWWRRAINTAREKNGGDAKDRFL<br>VDLYDHLNNLQSKGEALPATVRVPRQGGNLFIAGAQLDDTNKERRAIQ<br>ADLNAAANIGLRALLDPDWRGRWWYVPCKDGTSEPALDRIEGSTAFND<br>VRSLPTGDNSSRRAPREIENLWRDPSGDSLESGTWSPTRAYWDTVQSRV<br>IELLRRHAGLPTS (SEQ ID NO: 71) |
| LsCas12b<br>Laceyella<br>sacchari<br>WP_132221894.1 | MSIRSFKLKLKTKSGVNAEQLRRGLWRTHQLINDGIAYYMNWLVLLRQ<br>EDLFIRNKETNEIEKRSKEEIQAVLLERVHKQQQRNQWSGEVDEQTLLQ<br>ALRQLYEEIVPSVIGKSGNASLKARFFLGPLVDPNNKTTKDVSKSGPTPK<br>WKKMKDAGDPNWVQEYEKYMAERQTLVRLEEMGLIPLFPMYTDEVG<br>DIHWLPQASGYTRTWDRDMFQQAIERLLSWESWNRRVRERRAQPEKKT<br>HDFASRFSESDVQWMNKLREYEAQQEKSLEENAFAPNEPYALTKKALR<br>GWERVYHSWMRLDSAASEEAYWQEVATCQTAMRGEFGDPAIYQPLAQ<br>KENHDIWRGYPERVIDFAELNHLQRELRRAKEDATFTLPDSVDHPLWVR<br>YEAPGGTNIHGYDLVQDTKRNLTLILDKFILPDENGSWHEVKKVPFSLA<br>KSKQFHRQVWLQEEQKQKKREVVFYDYSTNLPHLGTLAGAKLQWDRN<br>FLNKRTQQQIEETGEIGKVFFNISVDVRPAVEVKNGRLQNGLGKALTVL<br>THPDGTKIVTGWKAEQLEKWVGESGRVSSLGLDSLSEGLRVMSIDLGQ<br>RTSATVSVFEITKEAPDNPYKFFYQLEGTEMFAVHQRSFLLALPGENPPQ<br>KIKQMREIRWKERNRIKQQVDQLSAILRLHKKVNEDERIQAIDKLLQKV<br>ASWQLNEEIATAWNQALSQLYSKAKENDLQWNQAIKNAHHQLEPVVG<br>KQISLWRKDLSTGRQGIAGLSLWSIEELEATKKLLTRWSKRSREPGVVK<br>RIERFETFAKQIQHHINQVKENRLKQLANLIVMTALGYKYDQEQKKWIE<br>VYPACQVVLFENLRSYRFSFERSRRENKKLMEWSHRSIPKLVQMQGELF<br>GLQVADVYAAYSSRYHGRTGAPGIRCHALTEADLRNETNIIHELIEAGFI<br>KEEHRPYLQQGDLVPWSGGELFATLQKPYDNPRILTLHADINAAQNIQK<br>RFWHPSMWFRVNCESVMEGEIVTYVPKNKTVHKKQGKTFRFVKVEGS<br>DVYEWAKWSKNRNKNTFSSITERKPPSSMILFRDPSGTFFKEQEWVEQK<br>TFWGKVQSMIQAYMKKTIVQRMEE (SEQ ID NO: 72) |
| DtCas12b<br>Dsulfonatronum<br>thiodismutans<br>WP_031386437 | MVLGRKDDTAELRRALWTTHEHVNLAVAEVERVLLRCRGRSYWTLDR<br>RGDPVHVPESQVAEDALAMAREAQRRNGWPVVGEDEEILLALRYLYEQ<br>IVPSCLLDDLGKPLKGDAQKIGTNYAGPLFDSDTCRRDEGKDVACCGPF<br>HEVAGKYLGALPEWATPISKQEFDGKDASHLRFKATGGDDAFFRVSIEK<br>ANAWYEDPANQDALKNKAYNKDDWKKEKDKGISSWAVKYIQKQLQL<br>GQDPRTEVRRKLWLELGLLPLFIPVFDKTMVGNLWNRLAVRLALAHLL<br>SWESWNHRAVQDQALARAKRDELAALFLGMEDGFAGLREYELRRNESI<br>KQHAFEPVDRPYVVSGRALRSWTRVREEWLRHGDTQESRKNICNRLQD<br>RLRGKFGDPDVFHWLAEDGQEALWKERDCVTSFSLLNDADGLLEKRK<br>GYALMTFADARLHPRWAMYEAPGGSNLRTYQIRKTENGLWADVVLLS<br>PRNESAAVEEKTFNVRLAPSGQLSNVSFDQIQKGSKMVGRCRYQSANQ<br>QFEGLLGGAEILFDRKRIANEQHGATDLASKPGHVWFKLTLDVRPQAPQ<br>GWLDGKGRPALPPEAKHFKTALSNKSKFADQVRPGLRVLSVDLGVRSF<br>AACSVFELVRGGPDQGTYFPAADGRTVDDPEKLWAKHERSFKITLPGEN<br>PSRKEEIARRAAMEELRSLNGDIRRLKAILRLSVLQEDDPRTEHLRLFME<br>AIVDDPAKSALNAELFKGFGDDRFRSTPDLWKQHCHFFHDKAEKVVAE<br>RFSRWRTETRPKSSSWQDWRERRGYAGGKSYWAVTYLEAVRGLILRW<br>NMRGRTYGEVNRQDKKQFGTVASALLHHINQLKEDRIKTGADMIIQAA<br>RGFVPRKNGAGWVQVHEPCRLILFEDLARYRFRTDRSRRENSRLMRWS<br>HREIVNEVGMQGELYGLHVDTTEAGFSSRYLASSGAPGVRCRHLVEEDF<br>HDGLPGMHLVGELDWLLPKDKDRTANEARRLLGGMVRPGMLVPWDG<br>GELFATLNAASQLHVIHADINAAQNLQRRFWGRCGEAIRIVCNQLSVDG<br>STRYEMAKAPKARLLGALQQLKNGDAPFHLTSIPNSQKPENSYVMTPTN<br>AGKKYRAGPGEKSSGEEDELALDIVEQAEELAQGRKTFFRDPSGVFFAP<br>DRWLPSEIYWSRIRRRIWQVTLERNSSGRQERAEMDEMPY (SEQ ID NO: 73) |

The prime editors described herein may also comprise Cas12a (Cpf1) (dCpf1) variants that may be used as a guide nucleotide sequence-programmable DNA-binding protein domain. The Cas12a (Cpf1) protein has a RuvC-like endonuclease domain that is similar to the RuvC domain of Cas9 but does not have a HNH endonuclease domain, and the N-terminal of Cas12a (Cpf1) does not have the alfa-helical recognition lobe of Cas9. It was shown in Zetsche et al., Cell, 163,759-771,2015 (which is incorporated herein by reference) that, the RuvC-like domain of Cas12a (Cpf1) is responsible for cleaving both DNA strands and inactivation of the RuvC-like domain inactivates Cas12a (Cpf1) nuclease activity.

In some embodiments, the napDNAbp is a single effector of a microbial CRISPR-Cas system. Single effectors of microbial CRISPR-Cas systems include, without limitation, Cas9, Cas12a (Cpf1), Cas12b1 (C2c1), Cas13a (C2c2), and Cas12c (C2c3). Typically, microbial CRISPR-Cas systems are divided into Class 1 and Class 2 systems. Class 1 systems have multisubunit effector complexes, while Class 2 systems have a single protein effector. For example, Cas9 and Cas12a (Cpf1) are Class 2 effectors. In addition to Cas9 and Cas12a (Cpf1), three distinct Class 2 CRISPR-Cas systems (Cas12b1, Cas13a, and Cas12c) have been described by Shmakov et al., "Discovery and Functional Characterization of Diverse Class 2 CRISPR Cas Systems", *Mol. Cell,* 2015 Nov. 5; 60(3): 385-397, the entire contents of which are hereby incorporated by reference.

Effectors of two of the systems, Cas12b1 and Cas12c, contain RuvC-like endonuclease domains related to Cas12a. A third system, Cas13a contains an effector with two predicated HEPN RNase domains. Production of mature CRISPR RNA is tracrRNA-independent, unlike production of CRISPR RNA by Cas12b1. Cas depends on both CRISPR RNA and tracrRNA for DNA cleavage. Bacterial Cas13a has been shown to possess a unique RNase activity for CRISPR RNA maturation distinct from its RNA-activated single-stranded RNA degradation activity. These RNase functions are different from each other and from the CRISPR RNA-processing behavior of Cas12a. See, e.g., East-Seletsky, et al., "Two distinct RNase activities of CRISPR-Cas13a enable guide-RNA processing and RNA detection", *Nature,* 2016 Oct. 13; 538(7624):270-273, the entire contents of which are hereby incorporated by reference. In vitro biochemical analysis of Cas13a in *Leptotrichia shahii* has shown that Cas13a is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobaccillus acidoterrastris* Cas12b1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the napDNAbp may be a C2c1, a C2c2, or a C2c3 protein. In some embodiments, the napDNAbp is a C2c1 protein. In some embodiments, the napDNAbp is a Cas13a protein. In some embodiments, the napDNAbp is a Cas12c protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12b1 (C2c1), Cas13a (C2c2), or Cas12c (C2c3) protein. In some embodiments, the napDNAbp is a naturally-occurring Cas12b1 (C2c1), Cas13a (C2c2), or Cas12c (C2c3) protein.

H. Cas9 Circular Permutants

In various embodiments, the prime editors disclosed herein may comprise a circular permutant of Cas9.

The term "circularly permuted Cas9" or "circular permutant" of Cas9 or "CP-Cas9") refers to any Cas9 protein, or variant thereof, that occurs or has been modify to engineered as a circular permutant variant, which means the N-terminus and the C-terminus of a Cas9 protein (e.g., a wild type Cas9 protein) have been topically rearranged. Such circularly permuted Cas9 proteins, or variants thereof, retain the ability to bind DNA when complexed with a guide RNA (gRNA). See, Oakes et al., "Protein Engineering of Cas9 for enhanced function," *Methods Enzymol,* 2014, 546: 491-511 and Oakes et al., "CRISPR-Cas9 Circular Permutants as Programmable Scaffolds for Genome Modification," *Cell,* Jan. 10, 2019, 176: 254-267, each of are incorporated herein by reference. The instant disclosure contemplates any previously known CP-Cas9 or use a new CP-Cas9 so long as the resulting circularly permuted protein retains the ability to bind DNA when complexed with a guide RNA (gRNA).

Any of the Cas9 proteins described herein, including any variant, ortholog, or naturally occurring Cas9 or equivalent thereof, may be reconfigured as a circular permutant variant.

In various embodiments, the circular permutants of Cas9 may have the following structure:

N-terminus-[original C-terminus]-[optional linker]-[original N-terminus]-C-terminus.

As an example, the present disclosure contemplates the following circular permutants of canonical *S. pyogenes* Cas9 (1368 amino acids of UniProtKB-Q99ZW2 (CAS9_STRP1) (numbering is based on the amino acid position in SEQ ID NO: 18)):

N-terminus-[1268-1368]-[optional linker]-[1-1267]-C-terminus;
N-terminus-[1168-1368]-[optional linker]-[1-1167]-C-terminus;
N-terminus-[1068-1368]-[optional linker]-[1-1067]-C-terminus;
N-terminus-[968-1368]-[optional linker]-[1-967]-C-terminus;
N-terminus-[868-1368]-[optional linker]-[1-867]-C-terminus;
N-terminus-[768-1368]-[optional linker]-[1-767]-C-terminus;
N-terminus-[668-1368]-[optional linker]-[1-667]-C-terminus;
N-terminus-[568-1368]-[optional linker]-[1-567]-C-terminus;
N-terminus-[468-1368]-[optional linker]-[1-467]-C-terminus;
N-terminus-[368-1368]-[optional linker]-[1-367]-C-terminus;
N-terminus-[268-1368]-[optional linker]-[1-267]-C-terminus;
N-terminus-[168-1368]-[optional linker]-[1-167]-C-terminus;

N-terminus-[68-1368]-[optional linker]-[1-67]-C-terminus; or
N-terminus-[10-1368]-[optional linker]-[1-9]-C-terminus, or the corresponding circular permutants of other Cas9 proteins (including other Cas9 orthologs, variants, etc).

In particular embodiments, the circular permuant Cas9 has the following structure (based on *S. pyogenes* Cas9 (1368 amino acids of UniProtKB-Q99ZW2 (CAS9_STRP1) (numbering is based on the amino acid position in SEQ ID NO: 18):
N-terminus-[102-1368]-[optional linker]-[1-101]-C-terminus;
N-terminus-[1028-1368]-[optional linker]-[1-1027]-C-terminus;
N-terminus-[1041-1368]-[optional linker]-[1-1043]-C-terminus;
N-terminus-[1249-1368]-[optional linker]-[1-1248]-C-terminus; or
N-terminus-[1300-1368]-[optional linker]-[1-1299]-C-terminus, or the corresponding circular permutants of other Cas9 proteins (including other Cas9 orthologs, variants, etc).

In still other embodiments, the circular permuant Cas9 has the following structure (based on *S. pyogenes* Cas9 (1368 amino acids of UniProtKB-Q99ZW2 (CAS9_STRP1) (numbering is based on the amino acid position in SEQ ID NO: 18):
N-terminus-[103-1368]-[optional linker]-[1-102]-C-terminus;
N-terminus-[1029-1368]-[optional linker]-[1-1028]-C-terminus;
N-terminus-[1042-1368]-[optional linker]-[1-1041]-C-terminus;
N-terminus-[1250-1368]-[optional linker]-[1-1249]-C-terminus; or
N-terminus-[1301-1368]-[optional linker]-[1-1300]-C-terminus, or the corresponding circular permutants of other Cas9 proteins (including other Cas9 orthologs, variants, etc).

In some embodiments, the circular permutant can be formed by linking a C-terminal fragment of a Cas9 to an N-terminal fragment of a Cas9, either directly or by using a linker, such as an amino acid linker. In some embodiments, The C-terminal fragment may correspond to the C-terminal 95% or more of the amino acids of a Cas9 (e.g., amino acids about 1300-1368), or the C-terminal 90%, 85%, 80%, 75%, 70%, 65%, 60%, 55%, 50%, 45%, 40%, 35%, 30%, 25%, 20%, 15%, 10%, or 5% or more of a Cas9 (e.g., any one of SEQ ID NOs: 77-86). The N-terminal portion may correspond to the N-terminal 95% or more of the amino acids of a Cas9 (e.g., amino acids about 1-1300), or the N-terminal 90%, 85%, 80%, 75%, 70%, 65%, 60%, 55%, 50%, 45%, 40%, 35%, 30%, 25%, 20%, 15%, 10%, or 5% or more of a Cas9 (e.g., of SEQ ID NO: 18).

In some embodiments, the circular permutant can be formed by linking a C-terminal fragment of a Cas9 to an N-terminal fragment of a Cas9, either directly or by using a linker, such as an amino acid linker. In some embodiments, the C-terminal fragment that is rearranged to the N-terminus, includes or corresponds to the C-terminal 30% or less of the amino acids of a Cas9 (e.g., amino acids 1012-1368 of SEQ ID NO: 18). In some embodiments, the C-terminal fragment that is rearranged to the N-terminus, includes or corresponds to the C-terminal 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1% of the amino acids of a Cas9 (e.g., the Cas9 of SEQ ID NO: 18). In some embodiments, the C-terminal fragment that is rearranged to the N-terminus, includes or corresponds to the C-terminal 410 residues or less of a Cas9 (e.g., the Cas9 of SEQ ID NO: 18). In some embodiments, the C-terminal portion that is rearranged to the N-terminus, includes or corresponds to the C-terminal 410, 400, 390, 380, 370, 360, 350, 340, 330, 320, 310, 300, 290, 280, 270, 260, 250, 240, 230, 220, 210, 200, 190, 180, 170, 160, 150, 140, 130, 120, 110, 100, 90, 80, 70, 60, 50, 40, 30, 20, or 10 residues of a Cas9 (e.g., the Cas9 of SEQ ID NO: 18). In some embodiments, the C-terminal portion that is rearranged to the N-terminus, includes or corresponds to the C-terminal 357, 341, 328, 120, or 69 residues of a Cas9 (e.g., the Cas9 of SEQ ID NO: 18).

In other embodiments, circular permutant Cas9 variants may be defined as a topological rearrangement of a Cas9 primary structure based on the following method, which is based on *S. pyogenes* Cas9 of SEQ ID NO: 18: (a) selecting a circular permutant (CP) site corresponding to an internal amino acid residue of the Cas9 primary structure, which dissects the original protein into two halves: an N-terminal region and a C-terminal region; (b) modifying the Cas9 protein sequence (e.g., by genetic engineering techniques) by moving the original C-terminal region (comprising the CP site amino acid) to preceed the original N-terminal region, thereby forming a new N-terminus of the Cas9 protein that now begins with the CP site amino acid residue. The CP site can be located in any domain of the Cas9 protein, including, for example, the helical-II domain, the RuvCIII domain, or the CTD domain. For example, the CP site may be located (relative the *S. pyogenes* Cas9 of SEQ ID NO: 18) at original amino acid residue 181, 199, 230, 270, 310, 1010, 1016, 1023, 1029, 1041, 1247, 1249, or 1282. Thus, once relocated to the N-terminus, original amino acid 181, 199, 230, 270, 310, 1010, 1016, 1023, 1029, 1041, 1247, 1249, or 1282 would become the new N-terminal amino acid. Nomenclature of these CP-Cas9 proteins may be referred to as Cas9-CP$^{181}$, Cas9-CP$^{199}$, Cas9-CP$^{230}$, Cas9-CP$^{270}$, Cas9-CP$^{310}$, Cas9-CP$^{1010}$, Cas9-CP$^{1016}$, Cas9-CP$^{1023}$, Cas9-CP$^{1029}$, Cas9-CP$^{1041}$, Cas9-CP$^{1247}$, Cas9-CP$^{1249}$, and Cas9-CP$^{1282}$, respectively. This description is not meant to be limited to making CP variants from SEQ ID NO: 18, but may be implemented to make CP variants in any Cas9 sequence, either at CP sites that correspond to these positions, or at other CP sites entirely. This description is not meant to limit the specific CP sites in any way. Virtually any CP site may be used to form a CP-Cas9 variant.

Exemplary CP-Cas9 amino acid sequences, based on the Cas9 of SEQ ID NO: 18, are provided below in which linker sequences are indicated by underlining and optional methionine (M) residues are indicated in bold. It should be appreciated that the disclosure provides CP-Cas9 sequences that do not include a linker sequence or that include different linker sequences. It should be appreciated that CP-Cas9 sequences may be based on Cas9 sequences other than that of SEQ ID NO: 18 and any examples provided herein are not meant to be limiting. Exemplary CP-Cas9 sequences are as follows:

| CP name | Sequence | SEQ ID NO: |
|---|---|---|
| CP1012 | DYKVYDVRKMIAKSEQEIGKATAKYFFYSNIMNFFKTE ITLANGEIRKRPLIETNGETGEIVWDKGRDFATVRKVLS MPQVNIVKKTEVQTGGFSKESILPKRNSDKLIARKKDW DPKKYGGFDSPTVAYSVLVVAKVEKGKSKKLKSVKEL LGITIMERSSFEKNPIDFLEAKGYKEVKKDLIIKLPKYSL FELENGRKRMLASAGELQKGNELALPSKYVNFLYLAS HYEKLKGSPEDNEQKQLFVEQHKHYLDEIIEQISEFSKR VILADANLDKVLSAYNKHRDKPIREQAENIIHLFTLTNL GAPAAFKYFDTTIDRKRYTSTKEVLDATLIHQSITGLYE TRIDLSQLGGD<u>GGSGGSGGSGGSGGSGGSGG</u>DKKYSIG LAIGTNSVGWAVITDEYKVPSKKFKVLGNTDRHSIKKN LIGALLFDSGETAEATRLKRTARRRYTRRKNRICYLQEI FSNEMAKVDDSFFHRLEESFLVEEDKKHERHPIFGNIVD EVAYHEKYPTIYHLRKKLVDSTDKADLRLIYLALAHMI KFRGHFLIEGDLNPDNSDVDKLFIQLVQTYNQLFEENPI NASGVDAKAILSARLSKSRRLENLIAQLPGEKKNGLFG NLIALSLGLTPNFKSNFDLAEDAKLQLSKDTYDDDLDN LLAQIGDQYADLFLAAKNLSDAILLSDILRVNTEITKAP LSASMIKRYDEHHQDLTLLKALVRQQLPEKYKEIFFDQ SKNGYAGYIDGGASQEEFYKFIKPILEKMDGTEELLVK LNREDLLRKQRTFDNGSIPHQIHLGELHAILRRQEDFYP FLKDNREKIEKILTFRIPYYVGPLARGNSRFAWMTRKSE ETITPWNFEEVVDKGASAQSFIERMTNFDKNLPNEKVL PKHSLLYEYFTVYNELTKVKYVTEGMRKPAFLSGEQK KAIVDLLFKTNRKVTVKQLKEDYFKKIECFDSVETSGV EDRFNASLGTYHDLLKIIKDKDFLDNEENEDILEDIVLT LTLFEDREMIEERLKTYAHLFDDKVMKQLKRRRYTGW GRLSRKLINGIRDKQSGKTILDFLKSDGFANRNFMQLIH DDSLTFKEDIQKAQVSGQGDSLHEHIANLAGSPAIKKGI LQTVKVVDELVKVMGRHKPENIVIEMARENQTTQKGQ KNSRERMKRIEEGIKELGSQILKEHPVENTQLQNEKLYL YYLQNGRDMYVDQELDINRLSDYDVDHIVPQSFLKDD SIDNKVLTRSDKNRGKSDNVPSEEVVKKMKNYWRQLL NAKLITQRKFDNLTKAERGGLSELDKAGFIKRQLVETR QITKHVAQILDSRMNTKYDENDKLIREVKVITLKSKLVS DFRKDFQFYKVREINNYHHAHDAYLNAVVGTALIKKY PKLESEFVYG | SEQ ID NO: 77 |
| CP1028 | EIGKATAKYFFYSNIMNFFKTEITLANGEIRKRPLIETNG ETGEIVWDKGRDFATVRKVLSMPQVNIVKKTEVQTGG FSKESILPKRNSDKLIARKKDWDPKKYGGFDSPTVAYS VLVVAKVEKGKSKKLKSVKELLGITIMERSSFEKNPIDF LEAKGYKEVKKDLIIKLPKYSLFELENGRKRMLASAGE LQKGNELALPSKYVNFLYLASHYEKLKGSPEDNEQKQ LFVEQHKHYLDEIIEQISEFSKRVILADANLDKVLSAYN KHRDKPIREQAENIIHLFTLTNLGAPAAFKYFDTTIDRK RYTSTKEVLDATLIHQSITGLYETRIDLSQLGGD<u>GGSGG SGGSGGSGGSGGSGGGM</u>DKKYSIGLAIGTNSVGWAVIT DEYKVPSKKFKVLGNTDRHSIKKNLIGALLFDSGETAE ATRLKRTARRRYTRRKNRICYLQEIFSNEMAKVDDSFF HRLEESFLVEEDKKHERHPIFGNIVDEVAYHEKYPTIYH LRKKLVDSTDKADLRLIYLALAHMIKFRGHFLIEGDLN PDNSDVDKLFIQLVQTYNQLFEENPINASGVDAKAILS ARLSKSRRLENLIAQLPGEKKNGLFGNLIALSLGLTPNF KSNFDLAEDAKLQLSKDTYDDDLDNLLAQIGDQYADL FLAAKNLSDAILLSDILRVNTEITKAPLSASMIKRYDEH HQDLTLLKALVRQQLPEKYKEIFFDQSKNGYAGYIDG GASQEEFYKFIKPILEKMDGTEELLVKLNREDLLRKQR TFDNGSIPHQIHLGELHAILRRQEDFYPFLKDNREKIEKI LTFRIPYYVGPLARGNSRFAWMTRKSEETITPWNFEEV VDKGASAQSFIERMTNFDKNLPNEKVLPKHSLLYEYFT VYNELTKVKYVTEGMRKPAFLSGEQKKAIVDLLFKTN RKVTVKQLKEDYFKKIECFDSVEISGVEDRFNASLGTY HDLLKIIKDKDFLDNEENEDILEDIVLTLTLFEDREMIEE RLKTYAHLFDDKVMKQLKRRRYTGWGRLSRKLINGIR DKQSGKTILDFLKSDGFANRNFMQLIHDDSLTFKEDIQ KAQVSGQGDSLHEHIANLAGSPAIKKGILQTVKVVDEL VKVMGRHKPENIVIEMARENQTTQKGQKNSRERMKRI EEGIKELGSQILKEHPVENTQLQNEKLYLYYLQNGRD MYVDQELDINRLSDYDVDHIVPQSFLKDDSIDNKVLTR SDKNRGKSDNVPSEEVVKKMKNYWRQLLNAKLITQR KFDNLTKAERGGLSELDKAGFIKRQLVETRQITKHVAQ ILDSRMNTKYDENDKLIREVKVITLKSKLVSDFRKDFQ FYKVREINNYHHAHDAYLNAVVGTALIKKYPKLESEF VYGDYKVYDVRKMIAKSEQ | SEQ ID NO: 78 |
| CP1041 | NININFFKTEITLANGEIRKRPLIETNGETGEIVWDKGRD FATVRKVLSMPQVNIVKKTEVQTGGFSKESILPKRNSD KLIARKKDWDPKKYGGFDSPTVAYSVLVVAKVEKGK | SEQ ID NO: 79 |

| CP name | Sequence | SEQ ID NO: |
|---|---|---|
| | SKKLKSVKELLGITIMERSSFEKNPIDFLEAKGYKEVKK DLIIKLPKYSLFELENGRKRMLASAGELQKGNELALPS KYVNFLYLASHYEKLKGSPEDNEQKQLFVEQHKHYLD EIIEQISEFSKRVILADANLDKVLSAYNKHRDKPIREQA ENIIHLFTLTNLGAPAAFKYFDTTIDRKRYTSTKEVLDA TLIHQSITGLYETRIDLSQLGGD<u>GGSGGSGGSGGSGGSG GSGG</u>DKKYSIGLAIGTNSVGWAVITDEYKVPSKKFKVL GNTDRHSIKKNLIGALLFDSGETAEATRLKRTARRRYT RRKNRICYLQEIFSNEMAKVDDSFFHRLEESFLVEEDK KHERHPIFGNIVDEVAYHEKYPTIYHLRKKLVDSTDKA DLRLIYLALAHMIKFRGHFLIEGDLNPDNSDVDKLFIQL VQTYNQLFEENPINASGVDAKAILSARLSKSRRLENLIA QLPGEKKNGLFGNLIALSLGLTPNFKSNFDLAEDAKLQ LSKDTYDDDLDNLLAQIGDQYADLFLAAKNLSDAILLS DILRVNTEITKAPLSASMIKRYDEHHQDLTLLKALVRQ QLPEKYKEIFFDQSKNGYAGYIDGGASQEEFYKFIKPIL EKMDGTEELLVKLNREDLLRKQRTFDNGSIPHQIHLGE LHAILRRQEDFYPFLKDNREKIEKILTFRIPYYVGPLAR GNSRFAWMTRKSEETITPWNFEEVVDKGASAQSFIER MTNFDKNLPNEKVLPKHSLLYEYFTVYNELTKVKYVT EGMRKPAFLSGEQKKAIVDLLFKTNRKVTVKQLKEDY FKKIECFDSVETSGVEDRFNASLGTYHDLLKIIKDKDFL DNEENEDILEDIVLTLTLFEDREMIEERLKTYAHLFDDK VMKQLKRRRYTGWGRLSRKLINGIRDKQSGKTILDFL KSDGFANRNFMQLIHDDSLTFKEDIQKAQVSGQGDSL HEHIANLAGSPAIKKGILQTVKVVDELVKVMGRHKPE NIVIEMARENQTTQKGQKNSRERMKRIEEGIKELGSQIL KEHPVENTQLQNEKLYLYYLQNGRDMYVDQELDINR LSDYDVDHIVPQSFLKDDSIDNKVLTRSDKNRGKSDNV PSEEVVKKMKNYWRQLLNAKLITQRKFDNLTKAERG GLSELDKAGFIKRQLVETRQITKHVAQILDSRMNTKYD ENDKLIREVKVITLKSKLVSDFRKDFQFYKVREINNYH HAHDAYLNAVVGTALIKKYPKLESEFVYGDYKVYDV RKMIAKSEQEIGKATAKYFFYS | |
| CP1249 | PEDNEQKQLFVEQHKHYLDEIIEQISEFSKRVILADANL DKVLSAYNKHRDKPIREQAENIIHLFTLTNLGAPAAFK YFDTTIDRKRYTSTKEVLDATLIHQSITGLYETRIDLSQL GGD<u>GGSGGSGGSGGSGGSGGSGG</u>MDKKYSIGLAIGTN SVGWAVITDEYKVPSKKFKVLGNTDRHSIKKNLIGALL FDSGETAEATRLKRTARRRYTRRKNRICYLQEIFSNEM AKVDDSFFHRLEESFLVEEDKKHERHPIFGNIVDEVAY HEKYPTIYHLRKKLVDSTDKADLRLIYLALAHMIKFRG HFLIEGDLNPDNSDVDKLFIQLVQTYNQLFEENPINASG VDAKAILSARLSKSRRLENLIAQLPGEKKNGLFGNLIAL SLGLTPNFKSNFDLAEDAKLQLSKDTYDDDLDNLLAQI GDQYADLFLAAKNLSDAILLSDILRVNTEITKAPLSAS MIKRYDEHHQDLTLLKALVRQQLPEKYKEIFFDQSKN GYAGYIDGGASQEEFYKFIKPILEKMDGTEELLVKLNR EDLLRKQRTFDNGSIPHQIHLGELHAILRRQEDFYPFLK DNREKIEKILTFRIPYYVGPLARGNSRFAWMTRKSEETI TPWNFEEVVDKGASAQSFIERMTNFDKNLPNEKVLPK HSLLYEYFTVYNELTKVKYVTEGMRKPAFLSGEQKKA IVDLLFKTNRKVTVKQLKEDYFKKIECFDSVETSGVED RFNASLGTYHDLLKIIKDKDFLDNEENEDILEDIVLTLT LFEDREMIEERLKTYAHLFDDKVMKQLKRRRYTGWG RLSRKLINGIRDKQSGKTILDFLKSDGFANRNFMQLIHD DSLTFKEDIQKAQVSGQGDSLHEHIANLAGSPAIKKGIL QTVKVVDELVKVMGRHKPENIVIEMARENQTTQKGQ KNSRERMKRIEEGIKELGSQILKEHPVENTQLQNEKLY LYYLQNGRDMYVDQELDINRLSDYDVDHIVPQSFLKD DSIDNKVLTRSDKNRGKSDNVPSEEVVKKMKNYWRQ LLNAKLITQRKFDNLTKAERGGLSELDKAGFIKRQLVE TRQITKHVAQILDSRMNTKYDENDKLIREVKVITLKSK LVSDFRKDFQFYKVREINNYHHAHDAYLNAVVGTALI KKYPKLESEFVYGDYKVYDVRKMIAKSEQEIGKATAK YFFYSNIMNFFKTEITLANGEIRKRPLIETNGETGEIVW DKGRDFATVRKVLSMPQVNIVKKTEVQTGGFSKESILP KRNSDKLIARKKDWDPKKYGGFDSPTVAYSVLVVAK VEKGKSKKLKSVKELLGITIMERSSFEKNPIDFLEAKGY KEVKKDLIIKLPKYSLFELENGRKRMLASAGELQKGNE LALPSKYVNFLYLASHYEKLKGS | SEQ ID NO: 80 |
| CP1300 | KPIREQAENIIHLFTLTNLGAPAAFKYFDTTIDRKRYTST KEVLDATLIHQSITGLYETRIDLSQLGGD<u>GGSGGSGGS GGSGGSGGSGGS</u>DKKYSIGLAIGTNSVGWAVITDEYKV PSKKFKVLGNTDRHSIKKNLIGALLFDSGETAEATRLK | SEQ ID NO: 81 |

| CP name | Sequence | SEQ ID NO: |
|---|---|---|
| | RTARRRYTRRKNRICYLQEIFSNEMAKVDDSFFHRLEE<br>SFLVEEDKKHERHPIFGNIVDEVAYHEKYPTIYHLRKK<br>LVDSTDKADLRLIYLALAHMIKFRGHFLIEGDLNPDNS<br>DVDKLFIQLVQTYNQLFEENPINASGVDAKAILSARLS<br>KSRRLENLIAQLPGEKKNGLFGNLIALSLGLTPNFKSNF<br>DLAEDAKLQLSKDTYDDDLDNLLAQIGDQYADLFLAA<br>KNLSDAILLSDILRVNTEITKAPLSASMIKRYDEHHQDL<br>TLLKALVRQQLPEKYKEIFFDQSKNGYAGYIDGGASQE<br>EFYKFIKPILEKMDGTEELLVKLNREDLLRKQRTFDNG<br>SIPHQIHLGELHAILRRQEDFYPFLKDNREKIEKILTFRIP<br>YYVGPLARGNSRFAWMTRKSEETITPWNFEEVVDKGA<br>SAQSFIERMTNFDKNLPNEKVLPKHSLLYEYFTVYNEL<br>TKVKYVTEGMRKPAFLSGEQKKAIVDLLFKTNRKVTV<br>KQLKEDYFKKIECFDSVETSGVEDRFNASLGTYHDLLKI<br>IKDKDFLDNEENEDILEDIVLTLTLFEDREMIEERLKTY<br>AHLFDDKVMKQLKRRRYTGWGRLSRKLINGIRDKQSG<br>KTILDFLKSDGFANRNFMQLIHDDSLTFKEDIQKAQVS<br>GQGDSLHEHIANLAGSPAIKKGILQTVKVVDELVKVM<br>GRHKPENIVIEMARENQTTQKGQKNSRERMKRIEEGIK<br>ELGSQILKEHPVENTQLQNEKLYLYYLQNGRDMYVDQ<br>ELDINRLSDYDVDHIVPQSFLKDDSIDNKVLTRSDKNR<br>GKSDNVPSEEVVKKMKNYWRQLLNAKLITQRKFDNL<br>TKAERGGLSELDKAGFIKRQLVETRQITKHVAQILDSR<br>MNTKYDENDKLIREVKVITLKSKLVSDFRKDFQFYKV<br>REINNYHHAHDAYLNAVVGTALIKKYPKLESEFVYGD<br>YKVYDVRKMIAKSEQEIGKATAKYFFYSNIMNFFKTEI<br>TLANGEIRKRPLIETNGETGEIVWDKGRDFATVRKVLS<br>MPQVNIVKKTEVQTGGFSKESILPKRNSDKLIARKKDW<br>DPKKYGGFDSPTVAYSVLVVAKVEKGKSKKLKSVKEL<br>LGITIMERSSFEKNPIDFLEAKGYKEVKKDLIIKLPKYSL<br>FELENGRKRMLASAGELQKGNELALPSKYVNFLYLAS<br>HYEKLKGSPEDNEQKQLFVEQHKHYLDEIIEQISEFSKR<br>VILADANLDKVLSAYNKHRD | |

The Cas9 circular permutants that may be useful in the prime editing constructs described herein. Exemplary C-terminal fragments of Cas9, based on the Cas9 of SEQ ID NO: 18, which may be rearranged to an N-terminus of Cas9, are provided below. It should be appreciated that such C-terminal fragments of Cas9 are exemplary and are not meant to be limiting. These exemplary CP-Cas9 fragments have the following sequences:

| CP name | Sequence | SEQ ID NO: |
|---|---|---|
| CP1012 C-terminal fragment | DYKVYDVRKMIAKSEQEIGKATAKYFFYSNIEVINFFKT<br>EITLANGEIRKRPLIETNGETGEIVWDKGRDFATVRKVL<br>SMPQVNIVKKTEVQTGGFSKESILPKRNSDKLIARKKD<br>WDPKKYGGFDSPTVAYSVLVVAKVEKGKSKKLKSVK<br>ELLGITIMERSSFEKNPIDFLEAKGYKEVKKDLIIKLPKY<br>SLFELENGRKRMLASAGELQKGNELALPSKYVNFLYL<br>ASHYEKLKGSPEDNEQKQLFVEQHKHYLDEIIEQISEFS<br>KRVILADANLDKVLSAYNKHRDKPIREQAENIIHLFTLT<br>NLGAPAAFKYFDTTIDRKRYTSTKEVLDATLIHQSITGL<br>YETRIDLSQLGGD | SEQ ID NO: 82 |
| CP1028 C-terminal fragment | EIGKATAKYFFYSNIMNFFKTEITLANGEIRKRPLIETNG<br>ETGEIVWDKGRDFATVRKVLSMPQVNIVKKTEVQTGG<br>FSKESILPKRNSDKLIARKKDWDPKKYGGFDSPTVAYS<br>VLVVAKVEKGKSKKLKSVKELLGITIMERSSFEKNPIDF<br>LEAKGYKEVKKDLIIKLPKYSLFELENGRKRMLASAGE<br>LQKGNELALPSKYVNFLYLASHYEKLKGSPEDNEQKQ<br>LFVEQHKHYLDEIIEQISEFSKRVILADANLDKVLSAYN<br>KHRDKPIREQAENIIHLFTLTNLGAPAAFKYFDTTIDRK<br>RYTSTKEVLDATLIHQSITGLYETRIDLSQLGGD | SEQ ID NO: 83 |
| CP1041 C-terminal fragment | NIMNFFKTEITLANGEIRKRPLIETNGETGEIVWDKGRD<br>FATVRKVLSMPQVNIVKKTEVQTGGFSKESILPKRNSD<br>KLIARKKDWDPKKYGGFDSPTVAYSVLVVAKVEKGK<br>SKKLKSVKELLGITIMERSSFEKNPIDFLEAKGYKEVKK<br>DLIIKLPKYSLFELENGRKRMLASAGELQKGNELALPS<br>KYVNFLYLASHYEKLKGSPEDNEQKQLFVEQHKHYLD<br>EIIEQISEFSKRVILADANLDKVLSAYNKHRDKPIREQA<br>ENIIHLFTLTNLGAPAAFKYFDTTIDRKRYTSTKEVLDA<br>TLIHQSITGLYETRIDLSQLGGD | SEQ ID NO: 84 |

-continued

| CP name | Sequence | SEQ ID NO: |
|---|---|---|
| CP1249 C-terminal fragment | PEDNEQKQLFVEQHKHYLDEIIEQISEFSKRVILADANL DKVLSAYNKHRDKPIREQAENIIHLFTLTNLGAPAAFK YFDTTIDRKRYTSTKEVLDATLIHQSITGLYETRIDLSQL GGD | SEQ ID NO: 85 |
| CP1300 C-terminal fragment | KPIREQAENIIHLFTLTNLGAPAAFKYFDTTIDRKRYTST KEVLDATLIHQSITGLYETRIDLSQLGGD | SEQ ID NO: 86 |

I. Cas9 Variants with Modified PAM Specificities

The prime editors of the present disclosure may also comprise Cas9 variants with modified PAM specificities. Some aspects of this disclosure provide Cas9 proteins that exhibit activity on a target sequence that does not comprise the canonical PAM (5'-NGG-3', where N is A, C, G, or T) at its 3'-end. In some embodiments, the Cas9 protein exhibits activity on a target sequence comprising a 5'-NGG-3' PAM sequence at its 3'-end. In some embodiments, the Cas9 protein exhibits activity on a target sequence comprising a 5'-NNG-3' PAM sequence at its 3'-end. In some embodiments, the Cas9 protein exhibits activity on a target sequence comprising a 5'-NNA-3' PAM sequence at its 3'-end. In some embodiments, the Cas9 protein exhibits activity on a target sequence comprising a 5'-NNC-3' PAM sequence at its 3'-end. In some embodiments, the Cas9 protein exhibits activity on a target sequence comprising a 5'-NNT-3' PAM sequence at its 3'-end. In some embodiments, the Cas9 protein exhibits activity on a target sequence comprising a 5'-NGT-3' PAM sequence at its 3'-end. In some embodiments, the Cas9 protein exhibits activity on a target sequence comprising a 5'-NGA-3' PAM sequence at its 3'-end. In some embodiments, the Cas9 protein exhibits activity on a target sequence comprising a 5'-NGC-3' PAM sequence at its 3'-end. In some embodiments, the Cas9 protein exhibits activity on a target sequence comprising a 5'-NAA-3' PAM sequence at its 3'-end. In some embodiments, the Cas9 protein exhibits activity on a target sequence comprising a 5'-NAC-3' PAM sequence at its 3'-end. In some embodiments, the Cas9 protein exhibits activity on a target sequence comprising a 5'-NAT-3' PAM sequence at its 3'-end. In still other embodiments, the Cas9 protein exhibits activity on a target sequence comprising a 5'-NAG-3' PAM sequence at its 3'-end.

It should be appreciated that any of the amino acid mutations described herein, (e.g., A262T) from a first amino acid residue (e.g., A) to a second amino acid residue (e.g., T) may also include mutations from the first amino acid residue to an amino acid residue that is similar to (e.g., conserved) the second amino acid residue. For example, mutation of an amino acid with a hydrophobic side chain (e.g., alanine, valine, isoleucine, leucine, methionine, phenylalanine, tyrosine, or tryptophan) may be a mutation to a second amino acid with a different hydrophobic side chain (e.g., alanine, valine, isoleucine, leucine, methionine, phenylalanine, tyrosine, or tryptophan). For example, a mutation of an alanine to a threonine (e.g., a A262T mutation) may also be a mutation from an alanine to an amino acid that is similar in size and chemical properties to a threonine, for example, serine. As another example, mutation of an amino acid with a positively charged side chain (e.g., arginine, histidine, or lysine) may be a mutation to a second amino acid with a different positively charged side chain (e.g., arginine, histidine, or lysine). As another example, mutation of an amino acid with a polar side chain (e.g., serine, threonine, asparagine, or glutamine) may be a mutation to a second amino acid with a different polar side chain (e.g., serine, threonine, asparagine, or glutamine). Additional similar amino acid pairs include, but are not limited to, the following: phenylalanine and tyrosine; asparagine and glutamine; methionine and cysteine; aspartic acid and glutamic acid; and arginine and lysine. The skilled artisan would recognize that such conservative amino acid substitutions will likely have minor effects on protein structure and are likely to be well tolerated without compromising function. In some embodiments, any amino of the amino acid mutations provided herein from one amino acid to a threonine may be an amino acid mutation to a serine. In some embodiments, any amino of the amino acid mutations provided herein from one amino acid to an arginine may be an amino acid mutation to a lysine. In some embodiments, any amino of the amino acid mutations provided herein from one amino acid to an isoleucine, may be an amino acid mutation to an alanine, valine, methionine, or leucine. In some embodiments, any amino of the amino acid mutations provided herein from one amino acid to a lysine may be an amino acid mutation to an arginine. In some embodiments, any amino of the amino acid mutations provided herein from one amino acid to an aspartic acid may be an amino acid mutation to a glutamic acid or asparagine. In some embodiments, any amino of the amino acid mutations provided herein from one amino acid to a valine may be an amino acid mutation to an alanine, isoleucine, methionine, or leucine. In some embodiments, any amino of the amino acid mutations provided herein from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure.

In some embodiments, the Cas9 protein comprises a combination of mutations that exhibit activity on a target sequence comprising a 5'-NAA-3' PAM sequence at its 3'-end. In some embodiments, the combination of mutations are present in any one of the clones listed in Table 1. In some embodiments, the combination of mutations are conservative mutations of the clones listed in Table 1. In some embodiments, the Cas9 protein comprises the combination of mutations of any one of the Cas9 clones listed in Table 1.

TABLE 1

NAA PAM Clones
Mutations from wild-type SpCas9 (e.g., SEQ ID NO: 18)

D177N, K218R, D614N, D1135N, P1137S, E1219V, A1320V, A1323D, R1333K
D177N, K218R, D614N, D1135N, E1219V, Q1221H, H1264Y, A1320V, R1333K
A10T, I322V, S409I, E427G, G715C, D1135N, E1219V, Q1221H, H1264Y, A1320V,
R1333K
A367T, K710E, R1114G, D1135N, P1137S, E1219V, Q1221H, H1264Y, A1320V, R1333K
A10T, I322V, S409I, E427G, R753G, D861N, D1135N, K1188R, E1219V, Q1221H,
H1264H, A1320V, R1333K
A10T, I322V, S409I, E427G, R654L, V743I, R753G, M1021T, D1135N, D1180G, K1211R,
E1219V, Q1221H, H1264Y, A1320V, R1333K
A10T, I322V, S409I, E427G, V743I, R753G, E762G, D1135N, D1180G, K1211R, E1219V,
Q1221H, H1264Y, A1320V, R1333K
A10T, I322V, S409I, E427G, R753G, D1135N, D1180G, K1211R, E1219V, Q1221H,
H1264Y, S1274R, A1320V, R1333K
A10T, I322V, S409I, E427G, A589S, R753G, D1135N, E1219V, Q1221H, H1264H,
A1320V, R1333K
A10T, I322V, S409I, E427G, R753G, E757K, G865G, D1135N, E1219V, Q1221H, H1264Y,
A1320V, R1333K
A10T, I322V, S409I, E427G, R654L, R753G, E757K, D1135N, E1219V, Q1221H, H1264Y,
A1320V, R1333K
A10T, I322V, S409I, E427G, K599R, M631A, R654L, K673E, V743I, R753G, N758H,
E762G, D1135N, D1180G, E1219V, Q1221H, Q1256R, H1264Y, A1320V, A1323D,
R1333K
A10T, I322V, S409I, E427G, R654L, K673E, V743I, R753G, E762G, N869S, N1054D,
R1114G, D1135N, D1180G, E1219V, Q1221H, H1264Y, A1320V, A1323D, R1333K
A10T, I322V, S409I, E427G, R654L, L727I, V743I, R753G, E762G, R859S, N946D,
F1134L, D1135N, D1180G, E1219V, Q1221H, H1264Y, N1317T, A1320V, A1323D,
R1333K
A10T, I322V, S409I, E427G, R654L, K673E, V743I, R753G, E762G, N803S, N869S,
Y1016D, G1077D, R1114G, F1134L, D1135N, D1180G, E1219V, Q1221H, H1264Y,
V1290G, L1318S, A1320V, A1323D, R1333K
A10T, I322V, S409I, E427G, R654L, K673E, V743I, R753G, E762G, N803S, N869S,
Y1016D, G1077D, R1114G, F1134L, D1135N, K1151E, D1180G, E1219V, Q1221H,
H1264Y, V1290G, E1318S, A1320V, R1333K
A10T, I322V, S409I, E427G, R654L, K673E, V743I, R753G, E762G, N803S, N869S,
Y1016D, G1077D, R1114G, F1134L, D1135N, D1180G, E1219V, Q1221H, H1264Y,
V1290G, L1318S, A1320V, A1323D, R1333K
A10T, I322V, S409I, E427G, R654L, K673E, F693L, V743I, R753G, E762G, N803S, N869S,
L921P, Y1016D, G1077D, F1080S, R1114G, D1135N, D1180G, E1219V, Q1221H, H1264Y,
L1318S, A1320V, A1323D, R1333K
A10T, I322V, S409I, E427G, E630K, R654L, K673E, V743I, R753G, E762G, Q768H,
N803S, N869S, Y1016D, G1077D, R1114G, F1134L, D1135N, D1180G, E1219V, Q1221H,
H1264Y, L1318S, A1320V, R1333K
A10T, I322V, S409I, E427G, R654L, K673E, F693L, V743I, R753G, E762G, Q768H,
N803S, N869S, Y1016D, G1077D, R1114G, F1134L, D1135N, D1180G, E1219V, Q1221H,
G1223S, H1264Y, L1318S, A1320V, R1333K
A10T, I322V, S409I, E427G, R654L, K673E, F693L, V743I, R753G, E762G, N803S, N869S,
L921P, Y1016D, G1077D, F1801S, R1114G, D1135N, D1180G, E1219V, Q1221H, H1264Y,
L1318S, A1320V, A1323D, R1333K
A10T, I322V, S409I, E427G, R654L, V743I, R753G, M1021T, D1135N, D1180G, K1211R,
E1219V, Q1221H, H1264Y, A1320V, R1333K
A10T, I322V, S409I, E427G, R654L, K673E, V743I, R753G, E762G, M673I, N803S, N869S,
G1077D, R1114G, D1135N, V1139A, D1180G, E1219V, Q1221H, A1320V, R1333K
A10T, I322V, S409I, E427G, R654L, K673E, V743I, R753G, E762G, N803S, N869S,
R1114G, D1135N, E1219V, Q1221H, A1320V, R1333K

In some embodiments, the Cas9 protein comprises an amino acid sequence that is at least 80% identical to the amino acid sequence of a Cas9 protein as provided by any one of the variants of Table 1. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 1.

In some embodiments, the Cas9 protein exhibits an increased activity on a target sequence that does not comprise the canonical PAM (5'-NGG-3') at its 3' end as compared to Streptococcus pyogenes Cas9 as provided by SEQ ID NO: 18. In some embodiments, the Cas9 protein exhibits an activity on a target sequence having a 3' end that is not directly adjacent to the canonical PAM sequence (5'-NGG-3') that is at least 5-fold increased as compared to the activity of Streptococcus pyogenes Cas9 as provided by SEQ ID NO: 18 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of Streptococcus pyogenes as provided by SEQ ID NO: 18 on the same target sequence. In some embodiments, the 3' end of the target sequence is directly adjacent to an AAA, GAA, CAA, or TAA sequence. In some embodiments, the Cas9 protein comprises a combination of mutations that exhibit activity on a target sequence comprising a 5'-NAC-3' PAM sequence at its 3'-end. In some embodiments, the combination of mutations are present in any one of the clones listed in Table 2. In some embodiments, the combination of mutations are conservative mutations of the clones listed in Table 2. In some embodiments, the Cas9 protein comprises the combination of mutations of any one of the Cas9 clones listed in Table 2.

TABLE 2

NAC PAM Clones
MUTATIONS FROM WILD-TYPE SPCAS9 (E.G., SEQ ID NO: 18)

T472I, R753G, K890E, D1332N, R1335Q, T1337N
I1057S, D1135N, P1301S, R1335Q, T1337N
T472I, R753G, D1332N, R1335Q, T1337N
D1135N, E1219V, D1332N, R1335Q, T1337N
T472I, R753G, K890E, D1332N, R1335Q, T1337N
I1057S, D1135N, P1301S, R1335Q, T1337N
T472I, R753G, D1332N, R1335Q, T1337N
T472I, R753G, Q771H, D1332N, R1335Q, T1337N
E627K, T638P, K652T, R753G, N803S, K959N, R1114G, D1135N, E1219V, D1332N, R1335Q, T1337N
E627K, T638P, K652T, R753G, N803S, K959N, R1114G, D1135N, K1156E, E1219V, D1332N, R1335Q, T1337N
E627K, T638P, V647I, R753G, N803S, K959N, G1030R, I1055E, R1114G, D1135N, E1219V, D1332N, R1335Q, T1337N
E627K, E630G, T638P, V647A, G687R, N767D, N803S, K959N, R1114G, D1135N, E1219V, D1332G, R1335Q, T1337N
E627K, T638P, R753G, N803S, K959N, R1114G, D1135N, E1219V, N1266H, D1332N, R1335Q, T1337N
E627K, T638P, R753G, N803S, K959N, I1057T, R1114G, D1135N, E1219V, D1332N, R1335Q, T1337N
E627K, T638P, R753G, N803S, K959N, R1114G, D1135N, E1219V, D1332N, R1335Q, T1337N
E627K, M631I, T638P, R753G, N803S, K959N, Y1036H, R1114G, D1135N, E1219V, D1251G, D1332G, R1335Q, T1337N
E627K, T638P, R753G, N803S, V875I, K959N, Y1016C, R1114G, D1135N, E1219V, D1251G, D1332G, R1335Q, T1337N, I1348V
K608R, E627K, T638P, V647I, R654L, R753G, N803S, T804A, K848N, V922A, K959N, R1114G, D1135N, E1219V, D1332N, R1335Q, T1337N
K608R, E627K, T638P, V647I, R753G, N803S, V922A, K959N, K1014N, V1015A, R1114G, D1135N, K1156N, E1219V, N1252D, D1332N, R1335Q, T1337N
K608R, E627K, R629G, T638P, V647I, A711T, R753G, K775R, K789E, N803S, K959N, V1015A, Y1036H, R1114G, D1135N, E1219V, N1286H, D1332N, R1335Q, T1337N
K608R, E627K, T638P, V647I, T740A, R753G, N803S, K948E, K959N, Y1016S, R1114G, D1135N, E1219V, N1286H, D1332N, R1335Q, T1337N
K608R, E627K, T638P, V647I, T740A, N803S, K948E, K959N, Y1016S, R1114G, D1135N, E1219V, N1286H, D1332N, R1335Q, T1337N
I670S, K608R, E627K, E630G, T638P, V647I, R653K, R753G, I795L, K797N, N803S, K866R, K890N, K959N, Y1016C, R1114G, D1135N, E1219V, D1332N, R1335Q, T1337N
K608R, E627K, T638P, V647I, T740A, G752R, R753G, K797N, N803S, K948E, K959N, V1015A, Y1016S, R1114G, D1135N, E1219V, N1266H, D1332N, R1335Q, T1337N
I570T, A589V, K608R, E627K, T638P, V647I, R654L, Q716R, R753G, N803S, K948E, K959N, Y1016S, R1114G, D1135N, E1207G, E1219V, N1234D, D1332N, R1335Q, T1337N
K608R, E627K, R629G, T638P, V647I, R654L, Q740R, R753G, N803S, K959N, N990S, T995S, V1015A, Y1036D, R1114G, D1135N, E1207G, E1219V, N1234D, N1266H, D1332N, R1335Q, T1337N
I562F, V565D, I570T, K608R, L625S, E627K, T638P, V647I, R654I, G752R, R753G, N803S, N808D, K959N, M1021L, R1114G, D1135N, N1177S, N1234D, D1332N, R1335Q, T1337N
I562F, I570T, K608R, E627K, T638P, V647I, R753G, E790A, N803S, K959N, V1015A, Y1036H, R1114G, D1135N, D1180E, A1184T, E1219V, D1332N, R1335Q, T1337N
I570T, K608R, E627K, T638P, V647I, R654H, R753G, E790A, N803S, K959N, V1015A, R1114G, D1127A, D1135N, E1219V, D1332N, R1335Q, T1337N
I570T, K608R, L625S, E627K, T638P, V647I, R654I, T703P, R753G, N803S, N808D, K959N, M1021L, R1114G, D1135N, E1219V, D1332N, R1335Q, T1337N
I570S, K608R, E627K, E630G, T638P, V647I, R653K, R753G, I795L, N803S, K866R, K890N, K959N, Y1016C, R1114G, D1135N, E1219V, D1332N, R1335Q, T1337N
I570T, K608R, E627K, T638P, V647I, R654H, R753G, E790A, N803S, K959N, V1016A, R1114G, D1135N, E1219V, K1246E, D1332N, R1335Q, T1337N
K608R, E627K, T638P, V647I, R654L, K673E, R753G, E790A, N803S, K948E, K959N, R1114G, D1127G, D1135N, D1180E, E1219V, N1286H, D1332N, R1335Q, T1337N
K608R, L625S, E627K, T638P, V647I, R654I, I670T, R753G, N803S, N808D, K959N, M1021L, R1114G, D1135N, E1219V, N1286H, D1332N, R1335Q, T1337N
E627K, M631V, T638P, V647I, K710E, R753G, N803S, N808D, K948E, M1021L, R1114G, D1135N, E1219V, D1332N, R1335Q, T1337N, S1338T, H1349R

In some embodiments, the Cas9 protein comprises an amino acid sequence that is at least 80% identical to the amino acid sequence of a Cas9 protein as provided by any one of the variants of Table 2. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 2.

In some embodiments, the Cas9 protein exhibits an increased activity on a target sequence that does not comprise the canonical PAM (5'-NGG-3') at its 3' end as compared to *Streptococcus pyogenes* Cas9 as provided by SEQ ID NO: 18. In some embodiments, the Cas9 protein exhibits an activity on a target sequence having a 3' end that is not directly adjacent to the canonical PAM sequence (5'-NGG-3') that is at least 5-fold increased as compared to the activity of *Streptococcus pyogenes* Cas9 as provided by SEQ ID NO: 18 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* as provided by SEQ ID NO: 18 on the same target sequence. In some embodiments, the 3' end of the target sequence is directly adjacent to an AAC, GAC, CAC, or TAC sequence.

In some embodiments, the Cas9 protein comprises a combination of mutations that exhibit activity on a target sequence comprising a 5'-NAT-3' PAM sequence at its 3'-end. In some embodiments, the combination of mutations are present in any one of the clones listed in Table 3. In some embodiments, the combination of mutations are conservative mutations of the clones listed in Table 3. In some embodiments, the Cas9 protein comprises the combination of mutations of any one of the Cas9 clones listed in Table 3.

TABLE 3

NAT PAM Clones
MUTATIONS FROM WILD-TYPE SPCAS9 (E.G., SEQ ID NO: 18)

| Mutations |
|---|
| K961E, H985Y, D1135N, K1191N, E1219V, Q1221H, A1320A, P1321S, R1335L |
| D1135N, G1218S, E1219V, Q1221H, P1249S, P1321S, D1322G, R1335L |
| V743I, R753G, E790A, D1135N, G1218S, E1219V, Q1221H, A1227V, P1249S, N1286K, A1293T, P1321S, D1322G, R1335L, T1339I |
| F575S, M631L, R654L, V748I, V743I, R753G, D853E, V922A, R1114G D1135N, G1218S, E1219V, Q1221H, A1227V, P1249S, N1286K, A1293T, P1321S, D1322G, R1335L, T1339I |
| F575S, M631L, R654L, R664K, R753G, D853E, V922A, R1114G D1135N, D1180G, G1218S, E1219V, Q1221H, P1249S, N1286K, P1321S, D1322G, R1335L |
| M631L, R654L, R753G, K797E, D853E, V922A, D1012A, R1114G D1135N, G1218S, E1219V, Q1221H, P1249S, N1317K, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, D596Y, M631L, R654L, R664K, R753G, D853E, V922A, R1114G, Y1131C, D1135N, D1180G, G1218S, E1219V, Q1221H, P1249S, Q1256R, P1321S, D1322G, R1335L |
| F575S, M631L, R654L, R664K, K710E, V750A, R753G, D853E, V922A, R1114G, Y1131C, D1135N, D1180G, G1218S, E1219V, Q1221H, P1249S, P1321S, D1322G, R1335L |
| F575S, M631L, K649R, R654L, R664K, R753G, D853E, V922A, R1114G, Y1131C, D1135N, K1156E, D1180G, G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, M631L, R654L, R664K, R753G, D853E, V922A, I1057G, R1114G, Y1131C, D1135N, D1180G, G1218S, E1219V, Q1221H, P1249S, N1308D, P1321S, D1322G, R1335L |
| M631L, R654L, R753G, D853E, V922A, R1114G, Y1131C, D1135N, E1150V, D1180G, G1218S, E1219V, Q1221H, P1249S, P1321S, D1332G, R1335L |
| M631L, R654L, R664K, R753G, D853E, I1057V, Y1131C, D1135N, D1180G, G1218S, E1219V, Q1221H, P1249S, P1321S, D1332G, R1335L |
| M631L, R654L, R664K, R753G, I1057V, R1114G, Y1131C, D1135N, D1180G, G1218S, E1219V, Q1221H, P1249S, P1321S, D1332G, R1335L |

The above description of various napDNAbps which can be used in connection with the presently disclose prime editors is not meant to be limiting in any way. The prime editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 variants have a nickase activity, i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats). The prime editors described herein may also comprise Cas9 equivalents, including Cas12a/Cpf1 and Cas12b proteins which are the result of convergent evolution. The napDNAbps used herein (e.g., SpCas9, Cas9 variant, or Cas9 equivalents) may also may also contain various modifications that alter/enhance their PAM specificities. Lastly, the application contemplates any Cas9, Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequences or a reference Cas9 equivalent (e.g., Cas12a/Cpf1).

In a particular embodiment, the Cas9 variant having expanded PAM capabilities is SpCas9 (H840A) VRQR (SEQ ID NO: 87), which has the following amino acid sequence (with the V, R, Q, R substitutions relative to the SpCas9 (H840A) of SEQ ID NO: 51 being show in bold underline. In addition, the methionine residue in SpCas9 (H840) was removed for SpCas9 (H840A) VRQR):

(SEQ ID NO: 87)
DKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVETSGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDAIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFVSPTVAYSVLVVAKVEKGKSKKLKSVKELLGITIMERSSFEKN

PIDFLEAKGYKEVKKDLIIKLPKYSLFELENGRKRMLASARELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKQYRSTKEVLDATLIHQSITGLYETRIDLSQLGGD

In another particular embodiment, the Cas9 variant having expanded PAM capabilities is SpCas9 (H840A) VRER, which has the following amino acid sequence (with the V, R, E, R substitutions relative to the SpCas9 (H840A) of SEQ ID NO: 51 being shown in bold underline. In addition, the methionine residue in SpCas9 (H840) was removed for SpCas9 (H840A) VRER):

(SEQ ID NO: 88)
DKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDAIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFVSPTVAYSVLVVAKVEKGKSKKLKSVKELLGITIMERSSFEKN

PIDFLEAKGYKEVKKDLIIKLPKYSLFELENGRKRMLASARELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKEYRSTKEVLDATLIHQSITGLYETRIDLSQLGGD

In some embodiments, the napDNAbp that functions with a non-canonical PAM sequence is an Argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 2016 July; 34(7):768-73. PubMed PMID: 27136078; Swarts et al., *Nature.* 507(7491) (2014):258-61; and Swarts et al., *Nucleic Acids Res.* 43(10) (2015):5120-9, each of which is incorporated herein by reference.

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA*. 2016 Apr. 12; 113(15):4057-62, the entire contents of which are hereby incorporated by reference). It should be appreciated that other argonaute proteins may be used, and are within the scope of this disclosure.

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "editing window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

For example, a napDNAbp domain with altered PAM specificity, such as a domain with at least 80%, at least 85%, at least 90%, at least 95%, or at least 99% sequence identity with wild type *Francisella novicida* Cpf1 (D917, E1006, and D1255) (SEQ ID NO: 74), which has the following amino acid sequence:

```
                                        (SEQ ID NO: 74)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

-continued
FKNDKSLTDLSQQVFDDYSVIGTAVLEYITQQIAPKNLDNPSKKEQELI

AKKTEKAKYLSLETIKLALEEFNKHRDIDKQCRFEEILANFAAIPMIFD

EIAQNKDNLAQISIKYQNQGKKDLLQASAEDDVKAIKDLLDQTNNLLHK

LKIPHISQSEDKANILDKDEHFYLVFEECYFELANIVPLYNKIRNYITQ

KPYSDEKFKLNFENSTLANGWDKNKEPDNTAILFIKDDKYYLGVMNKKN

NKIFDDKAIKENKGEGYKKIVYKLLPGANKMLPKVFFSAKSIKFYNPSE

DILRIRNHSTHTKNGSPQKGYEKFEFNIEDCRKFIDFYKQSISKHPEWK

DFGFRFSDTQRYNSIDEFYREVENQGYKLTFENISESYIDSVVNQGKLY

LFQIYNKDFSAYSKGRPNLHTLYWKALFDERNLQDVVYKLNGEAELFYR

KQSIPKKITHPAKEAIANKNKDNPKKESVFEYDLIKDKRFTEDKFFFHC

PITINFKSSGANKFNDEINLLLKEKANDVHILSIDRGERHLAYYTLVDG

KGNIIKQDTFNIIGNDRMKTNYHDKLAAIEKDRDSARKDWKKINNIKEM

KEGYLSQVVHEIAKLVIEYNAIVVFEDLNFGFKRGRFKVEKQVYQKLEK

MLIEKLNYLVFKDNEFDKTGGVLRAYQLTAPFETFKKMGKQTGIIYYVP

AGFTSKICPVTGFVNQLYPKYESVSKSQEFFSKFDKICYNLDKGYFEFS

FDYKNFGDKAAKGKWTIASFGSRLINFRNSDKNHNWDTREVYPTKELEK

LLKDYSIEYGHGECIKAAICGESDKKFFAKLTSVLNTILQMRNSKTGTE

LDYLISPVADVNGNFFDSRQAPKNMPQDADANGAYHIGLKGLMLLGRIK

NNQEGKKLNLVIKNEEYFEFVQNRNN
```

An additional napDNAbp domain with altered PAM specificity, such as a domain having at least 80%, at least 85%, at least 90%, at least 95%, or at least 99% sequence identity with wild type *Geobacillus thermodenitrificans* Cas9 (SEQ ID NO: 75), which has the following amino acid sequence:

```
                                        (SEQ ID NO: 75)
MKYKIGLDIGITSIGWAVINLDIPRIEDLGVRIFDRAENPKTGESLALP

RRLARSARRRLRRRKHRLERIRRLFVREGILTKEELNKLFEKKHEIDVW

QLRVEALDRKLNNDELARILLHLAKRRGFRSNRKSERTNKENSTMLKHI

EENQSILSSYRTVAEMVVKDPKFSLHKRNKEDNYTNTVARDDLEREIKL

IFAKQREYGNIVCTEAFEHEYISIWASQRPFASKDDIEKKVGFCTFEPK

EKRAPKATYTFQSFTVWEHINKLRLVSPGGIRALTDDERRLIYKQAFHK

NKITFHDVRTLLNLPDDTRFKGLLYDRNTTLKENEKVRFLELGAYHKIR

KAIDSVYGKGAAKSFRPIDFDTFGYALTMFKDDTDIRSYLRNEYEQNGK

RMENLADKVYDEELIEELLNLSFSKFGHLSLKALRNILPYMEQGEVYST

ACERAGYTFTGPKKKQKTVLLPNIPPIANPVVMRALTQARKVVNAIIKK

YGSPVSIHIELARELSQSFDERRKMQKEQEGNRKKNETAIRQLVEYGLT

LNPTGLDIVKFKLWSEQNGKCAYSLQPIEIERLLEPGYTEVDHVIPYSR

SLDDSYTNKVLVLTKENREKGNRTPAEYLGLGSERWQQFETFVLTNKQF

SKKKRDRLLRLHYDENEENEFKNRNLNDTRYISRFLANFIREHLKFADS

DDKQKVYTVNGRITAHLRSRWNFNKNREESNLHHAVDAAIVACTTPSDI

ARVTAFYQRREQNKELSKKTDPQFPQPWPHFADELQARLSKNPKESIKA
```

```
LNLGNYDNEKLESLQPVFVSRMPKRSITGAAHQETLRRYIGIDERSGKI

QTVVKKKLSEIQLDKTGHFPMYGKESDPRTYEAIRQRLLEHNNDPKKAF

QEPLYKPKKNGELGPIIRTIKIIDTTNQVIPLNDGKTVAYNSNIVRVDV

FEKDGKYYCVPIYTIDMMKGILPNKAIEPNKPYSEWKEMTEDYTFRFSL

YPNDLIRIEFPREKTIKTAVGEEIKIKDLFAYYQTIDSSNGGLSLVSHD

NNFSLRSIGSRTLKRFEKYQVDVLGNIYKVRGEKRVGVASSSHSKAGET

IRPL
```

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from Natronobacterium gregoryi (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 34(7): 768-73 (2016), PubMed PMID: 27136078; Swarts et al., *Nature*, 507(7491): 258-61 (2014); and Swarts et al., *Nucleic Acids Res.* 43(10) (2015): 5120-9, each of which is incorporated herein by reference. The sequence of *Natronobacterium gregoryi* Argonaute is provided in SEQ ID NO: 76.

The disclosed fusion proteins may comprise a napDNAbp domain having at least 80%, at least 85%, at least 90%, at least 95%, or at least 99% sequence identity with wild type *Natronobacterium gregoryi* Argonaute (SEQ ID NO: 76), which has the following amino acid sequence:

```
                                       (SEQ ID NO: 76)
MTVIDLDSTTTADELTSGHTYDISVTLTGVYDNTDEQHPRMSLAFEQDN

GERRYITLWKNTTPKDVFTYDYATGSTYIFTNIDYEVKDGYENLTATYQ

TTVENATAQEVGTTDEDETFAGGEPLDHHLDDALNETPDDAETESDSGH

VMTSFASRDQLPEWTLHTYTLTATDGAKTDTEYARRTLAYTVRQELYTD

HDAAPVATDGLMLLTPEPLGETPLDLDCGVRVEADETRTLDYTTAKDRL

LARELVEEGLKRSLWDDYLVRGIDEVLSKEPVLTCDEFDLHERYDLSVE

VGHSGRAYLHINFRHRFVPKLTLADIDDDNIYPGLRVKTTYRPRRGHIV

WGLRDECATDSLNTLGNQSVVAYHRNNQTPINTDLLDAIEAADRRVVET

RRQGHGDDAVSFPQELLAVEPNTHQIKQFASDGFHQQARSKTRLSASRC

SEKAQAFAERLDPVRLNGSTVEFSSEFFTGNNEQQLRLLYENGESVLTF

RDGARGAHPDETFSKGIVNPPESFEVAVVLPEQQADTCKAQWDTMADLL

NQAGAPPTRSETVQYDAFSSPESISLNVAGAIDPSEVDAAFVVLPPDQE

GFADLASPTETYDELKKALANMGIYSQMAYFDRFRDAKIFYTRNVALGL

LAAAGGVAFTTEHAMPGDADMFIGIDVSRSYPEDGASGQINIAATATAV

YKDGTILGHSSTRPQLGEKLQSTDVRDIMKNAILGYQQVTGESPTHIVI

HRDGFMNEDLDPATEFLNEQGVEYDIVEIRKQPQTRLLAVSDVQYDTPV

KSIAAINQNEPRATVATFGAPEYLATRDGGGLPRPIQIERVAGETDIET

LTRQVYLLSQSHIQVHNSTARLPITTAYADQASTHATKGYLVQTGAFES

NVGFL
```

In addition, any available methods may be utilized to obtain or construct a variant or mutant Cas9 protein. The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Because of their nature, gain-of-function mutations are usually dominant.

Mutations can be introduced into a reference Cas9 protein using site-directed mutagenesis. Older methods of site-directed mutagenesis known in the art rely on sub-cloning of the sequence to be mutated into a vector, such as an M13 bacteriophage vector, that allows the isolation of single-stranded DNA template. In these methods, one anneals a mutagenic primer (i.e., a primer capable of annealing to the site to be mutated but bearing one or more mismatched nucleotides at the site to be mutated) to the single-stranded template and then polymerizes the complement of the template starting from the 3' end of the mutagenic primer. The resulting duplexes are then transformed into host bacteria and plaques are screened for the desired mutation. More recently, site-directed mutagenesis has employed PCR methodologies, which have the advantage of not requiring a single-stranded template. In addition, methods have been developed that do not require sub-cloning. Several issues must be considered when PCR-based site-directed mutagenesis is performed. First, in these methods it is desirable to reduce the number of PCR cycles to prevent expansion of undesired mutations introduced by the polymerase. Second, a selection must be employed in order to reduce the number of non-mutated parental molecules persisting in the reaction. Third, an extended-length PCR method is preferred in order to allow the use of a single PCR primer set. And fourth, because of the non-template-dependent terminal extension activity of some thermostable polymerases it is often necessary to incorporate an end-polishing step into the procedure prior to blunt-end ligation of the PCR-generated mutant product.

Mutations may also be introduced by directed evolution processes, such as phage-assisted continuous evolution (PACE) or phage-assisted noncontinuous evolution (PANCE). The term "phage-assisted continuous evolution (PACE)," as used herein, refers to continuous evolution that employs phage as viral vectors. The general concept of PACE technology has been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015, International PCT Application, PCT/US2015/012022, filed Jan. 20, 2015, published as WO 2015/134121 on Sep. 11, 2015, and International PCT Application, PCT/US2016/027795, filed Apr. 15, 2016, published as WO 2016/168631 on Oct. 20, 2016, the entire contents of each of which are incorporated herein by reference. Variant Cas9s may also be obtain by phage-assisted non-continuous evolution (PANCE)," which as used herein, refers to non-continuous evolution that employs phage as viral vectors. PANCE is a simplified technique for rapid in vivo directed evolution using serial flask transfers of evolving 'selection phage' (SP), which contain a gene of interest to be evolved, across fresh E. coli host cells, thereby allowing genes inside the host E. coli to be held constant while genes contained in the SP continuously evolve. Serial flask transfers have long served as a widely-accessible approach for laboratory evolution of microbes, and, more recently, analogous approaches have been developed for bacteriophage evolution. The PANCE system features lower stringency than the PACE system.

Any of the references noted above which relate to Cas9 or Cas9 equivalents are hereby incorporated by reference in their entireties, if not already stated so.

J. Divided napDNAbp Domains for Split PE Delivery

In various embodiments, the prime editors described herein may be delivered to cells as two or more fragments which become assembled inside the cell (either by passive assembly, or by active assembly, such as using split intein sequences) into a reconstituted prime editor. In some cases, the self assembly may be passive whereby the two or more prime editor fragments associate inside the cell covalently or non-covalently to reconstitute the prime editor. In other cases, the self-assembly may be catalzyed by dimerization domains installed on each of the fragments. Examples of dimerization domains are described herein. In still other cases, the self-assembly may be catalyzed by split intein sequences installed on each of the prime editor fragments.

Split PE delivery may be advantageous to address various size constraints of different delivery approaches. For example, delivery approaches may include virus-based delivery methods, messenger RNA-based delivery methods, or RNP-based delivery (ribonucleoprotein-based delivery). And, each of these methods of delivery may be more efficient and/or effective by dividing up the prime editor into smaller pieces. Once inside the cell, the smaller pieces can assemble into a functional prime editor. Depending on the means of splitting, the divided prime editor fragments can be reassembled in a non-covalent manner or a covalent manner to reform the prime editor. In one embodiment, the prime editor can be split at one or more split sites into two or more fragments. The fragments can be unmodified (other than being split). Once the fragments are delivered to the cell (e.g., by direct delivery of a ribonucleoprotein complex or by nucleic delivery—e.g., mRNA delivery or virus vector based delivery), the fragments can reassociate covalently or non-covalently to reconstitute the prime editor. In another embodiment, the prime editor can be split at one or more split sites into two or more fragments. Each of the fragments can be modified to comprise a dimerization domain, whereby each fragment that is formed is coupled to a dimerization domain. Once delivered or expressed within a cell, the dimerization domains of the different fragments associate and bind to one another, bringing the different prime editor fragments together to reform a functional prime editor. In yet another embodiment, the prime editor fragment may be modified to comprise a split intein. Once delivered or expressed within a cell, the split intein domains of the different fragments associate and bind to one another, and then undergo trans-splicing, which results in the excision of the split-intein domains from each of the fragments, and a concomitant formation of a peptide bond between the fragments, thereby restoring the prime editor.

In one embodiment, the prime editor can be delivered using a split-intein approach.

The location of the split site can be positioned between any one or more pair of residues in the prime editor and in any domains therein, including within the napDNAbp domain, the polymerase domain (e.g., RT domain), linker domain that joins the napDNAbp domain and the polymerase domain.

In one embodiment, depicted in FIG. 66, the prime editor (PE) is divided at a split site within the napDNAbp.

In certain embodiments, the napDNAbp is a canonical SpCas9 polypeptide of SEQ ID NO: 18, as follows:

```
SpCas9          MDKKYSIGLDIGTNSVGWAVITDEYKVPSKKFKVLGN    SEQ ID NO:
Streptococcus   TDRHSIKKNLIGALLFDSGETAEATRLKRTARRRYTRR   18
pyogenes        KNRICYLQEIFSNEMAKVDDSFFHRLEESFLVEEDKKH
M1              ERHPIFGNIVDEVAYHEKYPTIYHLRKKLVDSTDKADL
SwissProt       RLIYLALAHMIKFRGHFLIEGDLNPDNSDVDKLFIQLVQ
Accession       TYNQLFEENPINASGVDAKAILSARLSKSRRLENLIAQL
No.             PGEKKNGLFGNLIALSLGLTPNFKSNFDLAEDAKLQLS
Q99ZW2          KDTYDDDLDNLLAQIGDQYADLFLAAKNLSDAILLSDI
Wild type       LRVNTEITKAPLSASMIKRYDEHHQDLTLLKALVRQQL
1368 AA         PEKYKEIFFDQSKNGYAGYIDGGASQEEFYKFIKPILEK
                MDGTEELLVKLNREDLLRKQRTFDNGSIPHQIHLGELH
                AILRRQEDFYPFLKDNREKIEKILTFRIPYYVGPLARGN
                SRFAWMTRKSEETITPWNFEEVVDKGASAQSFIERMTN
                FDKNLPNEKVLPKHSLLYEYFTVYNELTKVKYVTEGM
                RKPAFLSGEQKKAIVDLLFKTNRKVTVKQLKEDYFKKI
                ECFDSVETSGVEDRFNASLGTYHDLLKIIKDKDFLDNEE
                NEDILEDIVLTLTLFEDREMIEERLKTYAHLFDDKVMK
                QLKRRRYTGWGRLSRKLINGIRDKQSGKTILDFLKSDG
```

```
FANRNFMQLIHDDSLTFKEDIQKAQVSGQGDSLHEHIA
NLAGSPAIKKGILQTVKVVDELVKVMGRHKPENIVIEM
ARENQTTQKGQKNSRERMKRIEEGIKELGSQILKEHPV
ENTQLQNEKLYLYYLQNGRDMYVDQELDINRLSDYD
VDHIVPQSFLKDDSIDNKVLTRSDKNRGKSDNVPSEEV
VKKMKNYWRQLLNAKLITQRKFDNLTKAERGGLSEL
DKAGFIKRQLVETRQITKHVAQILDSRMNTKYDENDK
LIREVKVITLKSKLVSDFRKDFQFYKVREINNYHHAHD
AYLNAVVGTALIKKYPKLESEFVYGDYKVYDVRKMIA
KSEQEIGKATAKYFFYSNIMNFFKTEITLANGEIRKRPLI
ETNGETGEIVWDKGRDFATVRKVLSMPQVNIVKKTEV
QTGGFSKESILPKRNSDKLIARKKDWDPKKYGGFDSPT
VAYSVLVVAKVEKGKSKKLKSVKELLGITIMERSSFEK
NPIDFLEAKGYKEVKKDLIIKLPKYSLFELENGRKRML
ASAGELQKGNELALPSKYVNFLYLASHYEKLKGSPED
NEQKQLFVEQHKHYLDEIIEQISEFSKRVILADANLDKV
LSAYNKHRDKPIREQAENIIHLFTLTNLGAPAAFKYFDT
TIDRKRYTSTKEVLDATLIHQSITGLYETRIDLSQLGGD
```

In certain embodiments, the SpCas9 is split into two fragments at a split site located between residues 1 and 2, or 2 and 3, or 3 and 4, or 4 and 5, or 5 and 6, or 6 and 7, or 7 and 8, or 8 and 9, or 9 and 10, or between any two pair of residues located anywhere between residues 1-10, 10-20, 20-30, 30-40, 40-50, 50-60, 60-70, 70-80, 80-90, 90-100, 100-200, 200-300, 300-400, 400-500, 500-600, 600-700, 700-800, 800-900, 1000-1100, 1100-1200, 1200-1300, or 1300-1368 of canonical SpCas9 of SEQ ID NO: 18.

In certain embodiments, a napDNAbp is split into two fragments at a split site that is located at a pair of residue that corresponds to any two pair of residues located anywhere between positions 1-10, 10-20, 20-30, 30-40, 40-50, 50-60, 60-70, 70-80, 80-90, 90-100, 100-200, 200-300, 300-400, 400-500, 500-600, 600-700, 700-800, 800-900, 1000-1100, 1100-1200, 1200-1300, or 1300-1368 of canonical SpCas9 of SEQ ID NO: 18.

In certain embodiments, the SpCas9 is split into two fragments at a split site located between residues 1 and 2, or 2 and 3, or 3 and 4, or 4 and 5, or 5 and 6, or 6 and 7, or 7 and 8, or 8 and 9, or 9 and 10, or between any two pair of residues located anywhere between residues 1-10, 10-20, 20-30, 30-40, 40-50, 50-60, 60-70, 70-80, 80-90, 90-100, 100-200, 200-300, 300-400, 400-500, 500-600, 600-700, 700-800, 800-900, 1000-1100, 1100-1200, 1200-1300, or 1300-1368 of canonical SpCas9 of SEQ ID NO: 18. In certain embodiments, the split site is located one or more polypeptide bond sites (i.e., a "split site or split-intein split site"), fused to a split intein, and then delivered to cells as separately-encoded fusion proteins. Once the split-intein fusion proteins (i.e., protein halves) are expressed within a cell, the proteins undergo trans-splicing to form a complete or whole PE with the concomitant removal of the joined split-intein sequences.

For example, as shown in FIG. 66, the N-terminal extein can be fused to a first split-intein (e.g., N intein) and the C-terminal extein can be fused to a second split-intein (e.g., C intein). The N-terminal extein becomes fused to the C-terminal extein to reform a whole prime editor fusion protein comprising an napDNAbp domain and a polymerase domain (e.g., RT domain) upon the self-association of the N intein and the C intein inside the cell, followed by their self-excision, and the concomitant formation of a peptide bond between the N-terminal extein and C-terminal extein portions of a whole prime editor (PE).

To take advantage of a split-PE delivery strategy using split-inteins, the prime editor needs to be divided at one or more split sites to create at least two separate halves of a prime editor, each of which may be rejoined inside a cell if each half is fused to a split-intein sequence.

In certain embodiments, the prime editor is split at a single split site. In certain other embodiments, the prime editor is split at two split sites, or three split sites, or four split sites, or more.

In a preferred embodiment, the prime editor is split at a single split site to create two separate halves of a prime editor, each of which can be fused to a split intein sequence An exemplary split intein is the Ssp DnaE intein, which comprises two subunits, namely, DnaE-N and DnaE-C. The two different subunits are encoded by separate genes, namely dnaE-n and dnaE-c, which encode the DnaE-N and DnaE-C subunits, respectively. DnaE is a naturally occurring split intein in *Synechocytis* sp. PCC6803 and is capable of directing trans-splicing of two separate proteins, each comprising a fusion with either DnaE-N or DnaE-C.

Additional naturally occurring or engineered split-intein sequences are known in the or can be made from whole-intein sequences described herein or those available in the art. Examples of split-intein sequences can be found in Stevens et al., "A promiscuous split intein with expanded protein engineering applications," *PNAS*, 2017, Vol. 114: 8538-8543; Iwai et al., "Highly efficient protein trans-splicing by a naturally split DnaE intein from *Nostc punctiforme*, *FEBS Lett*, 580: 1853-1858, each of which are incorporated herein by reference. Additional split intein sequences can be found, for example, in WO 2013/045632, WO 2014/055782, WO 2016/069774, and EP2877490, the contents each of which are incorporated herein by reference.

In addition, protein splicing in trans has been described in vivo and in vitro (Shingledecker, et al., *Gene* 207:187 (1998), Southworth, et al., *EMBO J.* 17:918 (1998); Mills, et al., *Proc. Natl. Acad. Sci. USA*, 95:3543-3548 (1998); Lew, et al., *J. Biol. Chem.*, 273:15887-15890 (1998); Wu, et al., *Biochim. Biophys. Acta* 35732:1 (1998b), Yamazaki, et al., *J. Am. Chem. Soc.* 120:5591 (1998), Evans, et al., *J. Biol. Chem.* 275:9091 (2000); Otomo, et al., *Biochemistry* 38:16040-16044 (1999); Otomo, et al., *J. Biolmol. NMR* 14:105-114 (1999); Scott, et al., *Proc. Natl. Acad. Sci. USA* 96:13638-13643 (1999)) and provides the opportunity to express a protein as to two inactive fragments that subsequently undergo ligation to form a functional product, e.g., as shown in FIGS. 66 and 67 with regard to the formation of a complete PE fusion protein from two separately-expressed halves.

In various embodiments described herein, the continuous evolution methods (e.g., PACE) may be used to evolve a first portion of a base editor. A first portion could include a single component or domain, e.g., a Cas9 domain, a deaminase domain, or a UGI domain. The separately evolved component or domain can be then fused to the remaining portions of the base editor within a cell by separately express both the evolved portion and the remaining non-evolved portions with split-intein polypeptide domains. The first portion could more broadly include any first amino acid portion of a base editor that is desired to be evolved using a continuous evolution method described herein. The second portion would in this embodiment refer to the remaining amino acid portion of the base editor that is not evolved using the herein methods. The evolved first portion and the second portion of the base editor could each be expressed with split-intein polypeptide domains in a cell. The natural protein splicing mechanisms of the cell would reassemble the evolved first portion and the non-evolved second portion to form a single fusion protein evolved base editor. The evolved first portion may comprise either the N- or C-terminal part of the single fusion protein. In an analogous manner, use of a second orthogonal trans-splicing intein pair could allow the evolved first portion to comprise an internal part of the single fusion protein.

Thus, any of the evolved and non-evolved components of the base editors herein described may be expressed with split-intein tags in order to facilitate the formation of a complete base editor comprising the evolved and non-evolved component within a cell.

The mechanism of the protein splicing process has been studied in great detail (Chong, et al., J. Biol. Chem. 1996, 271, 22159-22168; Xu, M-Q & Perler, F. B. EMBO Journal, 1996, 15, 5146-5153) and conserved amino acids have been found at the intein and extein splicing points (Xu, et al., EMBO Journal, 1994, 13 5517-522). The constructs described herein contain an intein sequence fused to the 5'-terminus of the first gene (e.g., the evolved portion of the base editor). Suitable intein sequences can be selected from any of the proteins known to contain protein splicing elements. A database containing all known inteins can be found on the World Wide Web (Perler, F. B. Nucleic Acids Research, 1999, 27, 346-347). The intein sequence is fused at the 3' end to the 5' end of a second gene. For targeting of this gene to a certain organelle, a peptide signal can be fused to the coding sequence of the gene. After the second gene, the intein-gene sequence can be repeated as often as desired for expression of multiple proteins in the same cell. For multi-intein containing constructs, it may be useful to use intein elements from different sources. After the sequence of the last gene to be expressed, a transcription termination sequence must be inserted. In one embodiment, a modified intein splicing unit is designed so that it can both catalyze excision of the exteins from the inteins as well as prevent ligation of the exteins. Mutagenesis of the C-terminal extein junction in the *Pyrococcus* species GB-D DNA polymerase was found to produce an altered splicing element that induces cleavage of exteins and inteins but prevents subsequent ligation of the exteins (Xu, M-Q & Perler, F. B. EMBO Journal, 1996, 15, 5146-5153). Mutation of serine 538 to either an alanine or glycine induced cleavage but prevented ligation. Mutation of equivalent residues in other intein splicing units should also prevent extein ligation due to the conservation of amino acids at the C-terminal extein junction to the intein. A preferred intein not containing an endonuclease domain is the *Mycobacterium xenopi* GyrA protein (Telenti, et al. J. Bacteriol. 1997, 179, 6378-6382). Others have been found in nature or have been created artificially by removing the endonuclease domains from endonuclease containing inteins (Chong, et al. J. Biol. Chem. 1997, 272, 15587-15590). In a preferred embodiment, the intein is selected so that it consists of the minimal number of amino acids needed to perform the splicing function, such as the intein from the *Mycobacterium xenopi* GyrA protein (Telenti, A., et al., J. Bacteriol. 1997, 179, 6378-6382). In an alternative embodiment, an intein without endonuclease activity is selected, such as the intein from the *Mycobacterium xenopi* GyrA protein or the *Saccharaomyces cerevisiae* VMA intein that has been modified to remove endonuclease domains (Chong, 1997). Further modification of the intein splicing unit may allow the reaction rate of the cleavage reaction to be altered allowing protein dosage to be controlled by simply modifying the gene sequence of the splicing unit.

Inteins can also exist as two fragments encoded by two separately transcribed and translated genes. These so-called split inteins self-associate and catalyze protein-splicing activity in trans. Split inteins have been identified in diverse cyanobacteria and archaea (Caspi et al, Mol Microbiol. 50: 1569-1577 (2003); Choi J. et al, J Mol Biol. 556: 1093-1106 (2006.); Dassa B. et al, Biochemistry. 46:322-330 (2007.); Liu X. and Yang J., J Biol Chem. 275:26315-26318 (2003); Wu H. et al.

Proc Natl Acad Sci USA. £5:9226-9231 (1998.); and Zettler J. et al, FEBS Letters. 553:909-914 (2009)), but have not been found in eukaryotes thus far. Recently, a bioinformatic analysis of environmental metagenomic data revealed 26 different loci with a novel genomic arrangement. At each locus, a conserved enzyme coding region is interrupted by a split intein, with a freestanding endonuclease gene inserted between the sections coding for intein subdomains. Among them, five loci were completely assembled: DNA helicases (gp41-1, gp41-8); Inosine-5'-monophosphate dehydrogenase (IMPDH-1); and Ribonucleotide reductase catalytic subunits (NrdA-2 and NrdJ-1). This fractured gene organization appears to be present mainly in phages (Dassa et al, *Nucleic Acids Research*. 57:2560-2573 (2009)).

The split intein Npu DnaE was characterized as having the highest rate reported for the protein trans-splicing reaction. In addition, the Npu DnaE protein splicing reaction is considered robust and high-yielding with respect to different extein sequences, temperatures from 6 to 37° C., and the presence of up to 6M Urea (Zettler J. et al, FEBS Letters. 553:909-914 (2009); Iwai I. et al, FEBS Letters 550: 1853-1858 (2006)). As expected, when the Cys1 Ala mutation at the N-domain of these inteins was introduced, the initial N to S-acyl shift and therefore protein splicing was blocked. Unfortunately, the C-terminal cleavage reaction was also almost completely inhibited. The dependence of the asparagine cyclization at the C-terminal splice junction on the acyl shift at the N-terminal scissile peptide bond seems to be a unique property common to the naturally split DnaE intein alleles (Zettler J. et al. FEBS Letters. 555:909-914 (2009)).

The mechanism of protein splicing typically has four steps [29-30]: 1) an N—S or N—O acyl shift at the intein N-terminus, which breaks the upstream peptide bond and forms an ester bond between the N-extein and the side chain of the intein's first amino acid (Cys or Ser); 2) a transesterification relocating the N-extein to the intein C-terminus, forming a new ester bond linking the N-extein to the side chain of the C-extein's first amino acid (Cys, Ser, or Thr); 3) Asn cyclization breaking the peptide bond between the intein and the C-extein; and 4) a S—N or O—N acyl shift that replaces the ester bond with a peptide bond between the N-extein and C-extein.

Protein trans-splicing, catalyzed by split inteins, provides an entirely enzymatic method for protein ligation [31]. A split-intein is essentially a contiguous intein (e.g. a mini-intein) split into two pieces named N-intein and C-intein, respectively. The N-intein and C-intein of a split intein can associate non-covalently to form an active intein and catalyze the splicing reaction essentially in same way as a contiguous intein does. Split inteins have been found in nature and also engineered in laboratories [31-35]. As used herein, the term "split intein" refers to any intein in which one or more peptide bond breaks exists between the N-terminal and C-terminal amino acid sequences such that the N-terminal and C-terminal sequences become separate molecules that can non-covalently reassociate, or reconstitute, into an intein that is functional for trans-splicing reactions. Any catalytically active intein, or fragment thereof, may be used to derive a split intein for use in the methods of the invention. For example, in one aspect the split intein may be derived from a eukaryotic intein. In another aspect, the split intein may be derived from a bacterial intein. In another aspect, the split intein may be derived from an archaeal intein. Preferably, the split intein so-derived will possess only the amino acid sequences essential for catalyzing trans-splicing reactions.

As used herein, the "N-terminal split intein (In)" refers to any intein sequence that comprises an N-terminal amino acid sequence that is functional for trans-splicing reactions. An In thus also comprises a sequence that is spliced out when trans-splicing occurs. An In can comprise a sequence that is a modification of the N-terminal portion of a naturally occurring intein sequence. For example, an In can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the In.

As used herein, the "C-terminal split intein (Ic)" refers to any intein sequence that comprises a C-terminal amino acid sequence that is functional for trans-splicing reactions. In one aspect, the Ic comprises 4 to 7 contiguous amino acid residues, at least 4 amino acids of which are from the last β-strand of the intein from which it was derived. An Ic thus also comprises a sequence that is spliced out when trans-splicing occurs. An Ic can comprise a sequence that is a modification of the C-terminal portion of a naturally occurring intein sequence. For example, an Ic can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the Ic.

In some embodiments of the invention, a peptide linked to an Ic or an In can comprise an additional chemical moiety including, among others, fluorescence groups, biotin, polyethylene glycol (PEG), amino acid analogs, unnatural amino acids, phosphate groups, glycosyl groups, radioisotope labels, and pharmaceutical molecules. In other embodiments, a peptide linked to an Ic can comprise one or more chemically reactive groups including, among others, ketone, aldehyde, Cys residues and Lys residues. The N-intein and C-intein of a split intein can associate non-covalently to form an active intein and catalyze the splicing reaction when an "intein-splicing polypeptide (ISP)" is present. As used herein, "intein-splicing polypeptide (ISP)" refers to the portion of the amino acid sequence of a split intein that remains when the Ic, In, or both, are removed from the split intein. In certain embodiments, the In comprises the ISP. In another embodiment, the Ic comprises the ISP. In yet another embodiment, the ISP is a separate peptide that is not covalently linked to In nor to Ic.

Split inteins may be created from contiguous inteins by engineering one or more split sites in the unstructured loop or intervening amino acid sequence between the −12 conserved beta-strands found in the structure of mini-inteins [25-28]. Some flexibility in the position of the split site within regions between the beta-strands may exist, provided that creation of the split will not disrupt the structure of the intein, the structured beta-strands in particular, to a sufficient degree that protein splicing activity is lost.

In protein trans-splicing, one precursor protein consists of an N-extein part followed by the N-intein, another precursor protein consists of the C-intein followed by a C-extein part, and a trans-splicing reaction (catalyzed by the N- and C-inteins together) excises the two intein sequences and links the two extein sequences with a peptide bond. Protein trans-splicing, being an enzymatic reaction, can work with very low (e.g. micromolar) concentrations of proteins and can be carried out under physiological conditions.

[2] Other Programmable Nucleases

In various embodiments described herein, the prime editors comprise a napDNAbp, such as a Cas9 protein. These proteins are "programmable" by way of their becoming complexed with a guide RNA (or a PEgRNA, as the case may be), which guides the Cas9 protein to a target site on the DNA which possess a sequence that is complementary to the spacer portion of the gRNA (or PEgRNA) and also which possesses the required PAM sequence. However, in certain embodiment envisioned here, the napDNAbp may be substituted with a different type of programmable protein, such as a zinc finger nuclease or a transcription activator-like effector nuclease (TALEN).

Figure 1J:
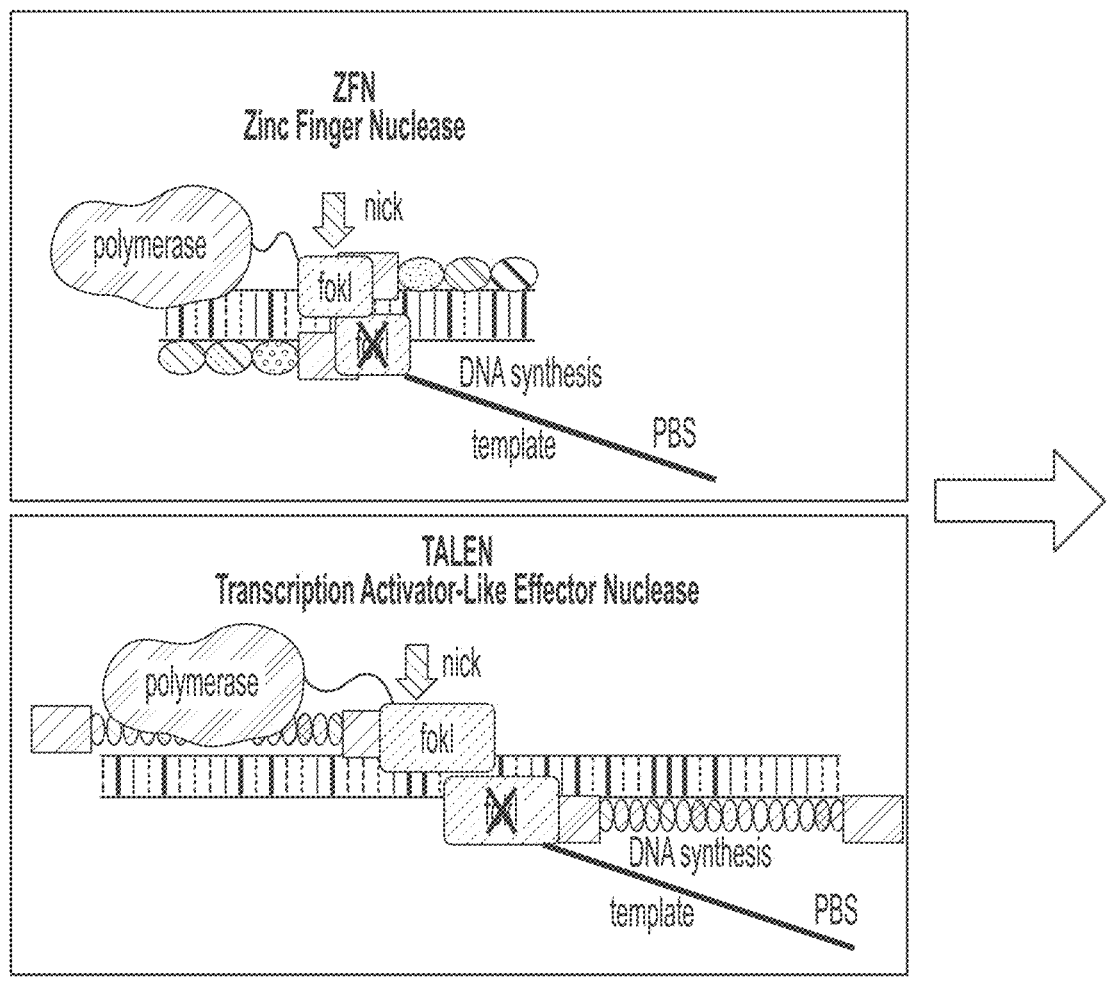
Figure 1L:
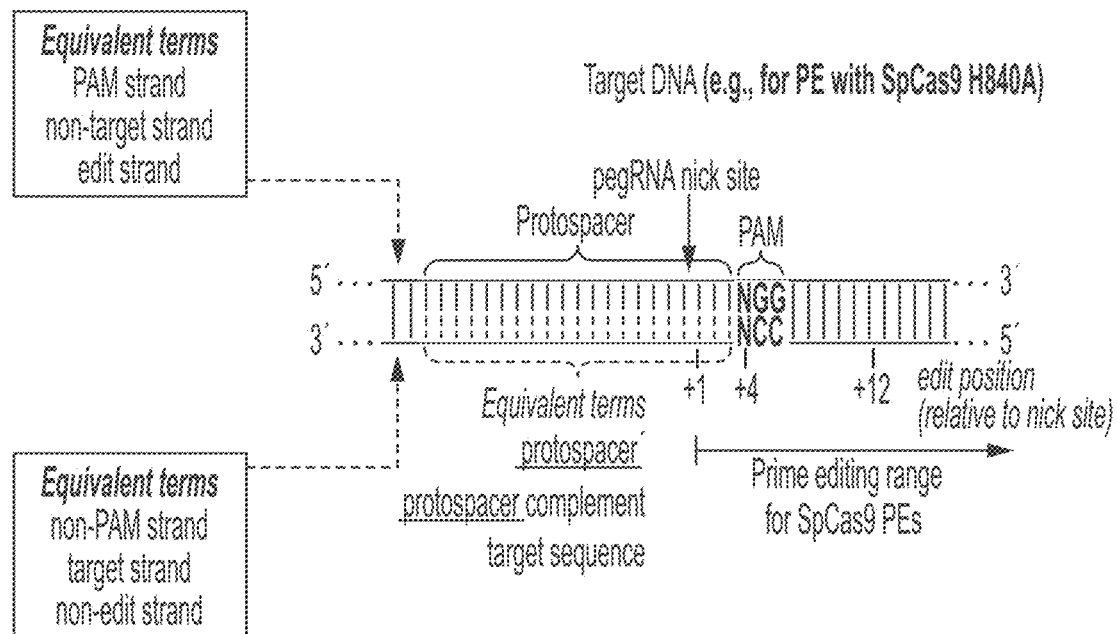
FIG. 1L depicts, in one embodiment, the anatomical features of a target DNA that may be edited by prime editing. The target DNA comprises a "non-target strand" and a "target strand." The target-strand is the strand that becomes annealed to the spacer of a PEgRNA of a prime editor complex that recognizes the PAM site (in this case, NGG, which is recognized by the canonical SpCas9-based prime editors) The target strand may also be referred to as the "non-PAM strand" or the "non-edit strand." By contrast, the non-target strand (i.e., the strand containing the protospacer and the PAM sequence of NGG) may be referred to as the "PAM-strand" or the "edit strand." In various embodiments, the nick site of the PE complex will be in the protospacer on the PAM-strand (e.g., with the SpCas9-based PE). The location of the nick will be characteristic of the particular Cas9 that forms the PE. For example, with an SpCas9-based PE, the nick site is in the phosphodiester bond between bases three ("−3" position relative to the position 1 of the PAM sequence) and four ("−4" position relative to position 1 of the PAM sequence). The nick site in the protospacer forms a free 3' hydroxyl group, which as seen in the following figures, complexes with the primer binding site of the extension arm of the PEgRNA and provides the substrate to begin polymerization of a single strand of DNA code for by the DNA synthesis template of the extension arm of the PEgRNA. This polymerization reaction is catalyzed by the polymerase (e.g., reverse transcriptase) of the PE fusion protein in the 5' to 3' direction. Polymerization terminates before reaching the gRNA core (e.g., by inclusion of a polymerization termination signal, or secondary structure, which functions to terminate the polymerization activity of PE), producing a single strand DNA flap that is extended from the original 3' hydroxyl group of the nicked PAM strand. The DNA synthesis template codes for a single strand DNA that is homologous to the endogenous 5'-ended single strand of DNA that immediately follows the nick site on the PAM strand and incorporates the desired nucleotide change (e.g., single base substitution, insertion, deletion, inversion). The position of the desired edit can be in any position following downstream of the nick site on the PAM strand, which can include position +1, +2, +3, +4 (the start of the PAM site), +5 (position 2 of the PAM site), +6 (position 3 of the PAM site), +7, +8, +9, +10, +11, +12, +13, +14, +15, +16, +17, +18, +19, +20, +21, +22, +23, +24, +25, +26, +27, +28, +29, +30, +31, +32, +33, +34, +35, +36, +37, +38, +39, +40, +41, +42, +43, +44, +45, +46, +47, +48, +49, +50, +51, +52, +53, +54, +55, +56, +57, +58, +59, +60, +61, +62, +63, +64, +65, +66, +67, +68, +69, +70, +71, +72, +73, +74, +75, +76, +77, +78, +79, +80, +81, +82, +83, +84, +85, +86, +87, +88, +89, +90, +91, +92, +93, +94, +95, +96, +97, +98, +99, +100, +101, +102, +103, +104, +105, +106, +107, +108, +109, +110, +111, +112, +113, +114, +115, +116, +117, +118, +119, +120, +121, +122, +123, +124, +125, +126, +127, +128, +129, +130, +131, +132, +133, +134, +135, +136, +137, +138, +139, +140, +141, +142, +143, +144, +145, +146, +147, +148, +149, or +150, or more (relative to the downstream position of the nick site). Once the 3'end single stranded DNA (containing the edit of interest) replaces the endogenous 5' end single stranded DNA, the DNA repair and replication processes will result in permanent installation of the edit site on the PAM strand, and then correction of the mismatch on the non-PAM strand that will exist at the edit site. In this way, the edit will extend to both strands of DNA on the target DNA site. It will be appreciated that reference to "edited strand" and "non-edited" strand only intends to delineate the strands of DNA involved in the PE mechanism. The "edited strand" is the strand that first becomes edited by replacement of the 5' ended single strand DNA immediately downstream of the nick site with the synthesized 3' ended single stranded DNA containing the desired edit. The "non-edited" strand is the strand pair with the edited strand, but which itself also becomes edited through repair and/or replication to be complementary to the edited strand, and in particular, the edit of interest.
Figure 1M:
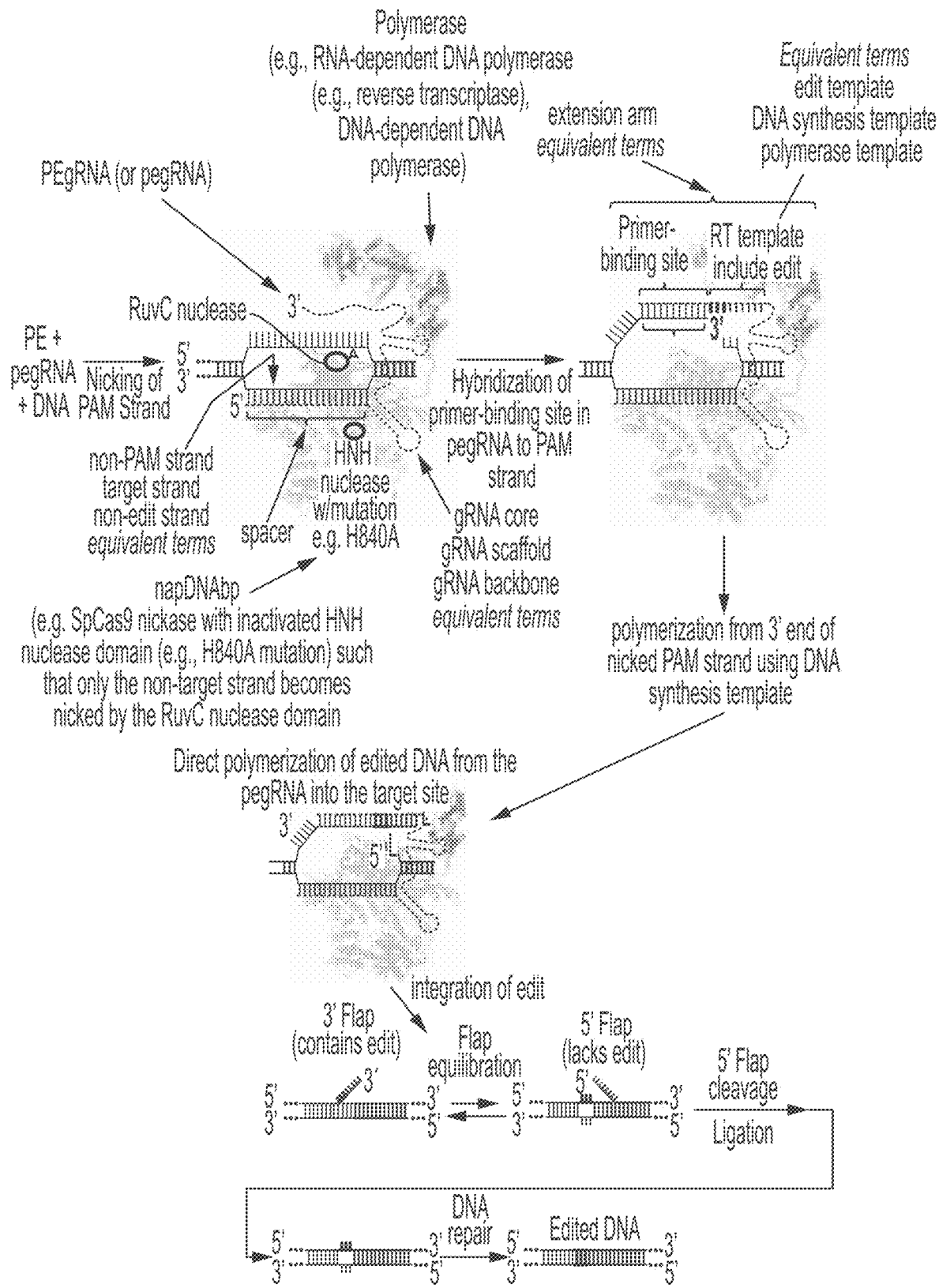
FIG. 1M depicts the mechanism of prime editing showing the anatomical features of the target DNA, prime editor complex, and the interaction between the PEgRNA and the target DNA. First, a prime editor comprising a fusion protein having a polymerase (e.g., reverse transcriptase) and a napDNAbp (e.g., SpCas9 nickase, e.g., a SpCas9 having a deactivating mutation in an HNH nuclease domain (e.g., H840A) or a deactivating mutation in a RuvC nuclease domain (D10A)) is complexed with a PEgRNA and DNA having a target DNA to be edited. The PEgRNA comprises a spacer, gRNA core (aka gRNA scaffold or gRNA backbone) (which binds to the napDNAbp), and an extension arm. The extension arm can be at the 3' end, the 5' end, or somewhere within the PEgRNA molecule. As shown, the extension arm is at the 3' end of the PEgRNA. The extension arm comprises in the 3' to 5' direction a primer binding site and a DNA synthesis template (comprising both an edit of interest and regions of homology (i.e., homology arms) that are homologous with the 5' ended single stranded DNA immediately following the nick site on the PAM strand. As shown, once the nick is introduced thereby producing a free 3' hydroxyl group immediately upstream of the nick site, the region immediately upstream of the nick site on the PAM strand anneals to a complementary sequence at the 3' end of the extension arm referred to as the "primer binding site," creating a short double-stranded region with an available 3' hydroxyl end, which forms a substrate for the polymerase of the prime editor complex. The polymerase (e.g., reverse transcriptase) then polymerase as strand of DNA from the 3' hydroxyl end to the end of the extension arm. The sequence of the single stranded DNA is coded for by the DNA synthesis template, which is the portion of the extension arm (i.e., excluding the primer binding site) that is "read" by the polymerase to synthesize new DNA. This polymerization effectively extends the sequence of the original 3' hydroxyl end of the initial nick site. The DNA synthesis template encodes a single strand of DNA that comprises not only the desired edit, but also regions that are homologous to the endogenous single strand of DNA immediately downstream of the nick site on the PAM strand. Next, the encoded 3' ended single strand of DNA (i.e., the 3' single strand DNA flap) displaces the corresponding homologous endogenous 5'-ended single strand of DNA immediately downstream of the nick site on the PAM strand, forming a DNA intermediate having a 5'-ended single strand DNA flap, which is removed by the cell (e.g., by a flap endonuclease). The 3'-ended single strand DNA flap, which anneals to the complement of the endogenous 5'-ended single strand DNA flap, is ligated to the endogenous strand after the 5' DNA flap is removed. The desired edit in the 3' ended single strand DNA flap, now annealed and ligate, forms a mismatch with the complement strand, which undergoes DNA repair and/or a round of replication, thereby permanently installing the desired edit on both strands.

FIG. 1J depicts such a variation of prime editing contemplated herein that replaces the napDNAbp (e.g., SpCas9 nickase) with any programmable nuclease domain, such as zinc finger nucleases (ZFN) or transcription activator-like effector nucleases (TALEN). As such, it is contemplated that suitable nucleases do not necessarily need to be "programmed" by a nucleic acid targeting molecule (such as a guide RNA), but rather, may be programmed by defining the specificity of a DNA-binding domain, such as and in particular, a nuclease. Just as in prime editing with napDNAbp moieties, it is preferable that such alternative programmable nucleases be modified such that only one strand of a target DNA is cut. In other words, the programmable nucleases should function as nickases, preferably. Once a programmable nuclease is selected (e.g., a ZFN or a TALEN), then additional functionalities may be engineered into the system to allow it to operate in accordance with a prime editing-like mechanism. For example, the programmable nucleases may be modified by coupling (e.g., via a chemical linker) an RNA or DNA extension arm thereto, wherein the extension arm comprises a primer binding site (PBS) and a DNA synthesis template. The programmable nuclease may also be coupled (e.g., via a chemical or amino acid linker) to a polymerase, the nature of which will depend upon whether the extension arm is DNA or RNA. In the case of an RNA extension arm, the polymerase can be an RNA-dependent DNA polymerase (e.g., reverse transcriptase). In the case of a DNA extension arm, the polymerase can be a DNA-dependent DNA polymerase (e.g., a prokaryotic polymerase, including Pol I, Pol II, or Pol III, or a eukaryotic polymerase, including Pol a, Pol b, Pol g, Pol d, Pol e, or Pol z). The system may also include other functionalities added as fusions to the programmable nucleases, or added in trans to facilitate the reaction as a whole (e.g., (a) a helicase to unwind the DNA at the cut site to make the cut strand with the 3' end available as a primer, (b) a FEN1 to help remove the endogenous strand on the cut strand to drive the reaction towards replacement of the endogenous strand with the synthesized strand, or (c) a nCas9:gRNA complex to create a second site nick on the opposite strand, which may help drive the integration of the synthesize repair through favored cellular repair of the non-edited strand). In an analogous manner to prime editing with a napDNAbp, such a complex with an otherwise programmable nuclease could be used to synthesize and then install a newly synthesized replacement strand of DNA carrying an edit of interest permanently into a target site of DNA.

Suitable alternative programmable nucleases are well known in the art which may be used in place of a napD-NAbp:gRNA complex to construct an alternative prime editor system that can be programmed to selectively bind a target site of DNA, and which can be further modified in the manner described above to co-localize a polymerase and an RNA or DNA extension arm comprising a primer binding site and a DNA synthesis template to specific nick site. For example, and as represented in FIG. 1J, Transcription Activator-Like Effector Nucleases (TALENs) may be used as the programmable nuclease in the prime editing methods and compositions of matter described herein. TALENS are artificial restriction enzymes generated by fusing the TAL effector DNA binding domain to a DNA cleavage domain. These reagents enable efficient, programmable, and specific DNA cleavage and represent powerful tools for genome editing in situ. Transcription activator-like effectors (TALEs) can be quickly engineered to bind practically any DNA sequence. The term TALEN, as used herein, is broad and includes a monomeric TALEN that can cleave double stranded DNA without assistance from another TALEN. The term TALEN is also used to refer to one or both members of a pair of TALENs that are engineered to work together to cleave DNA at the same site. TALENs that work together may be referred to as a left-TALEN and a right-TALEN, which references the handedness of DNA. See U.S. Ser. No. 12/965,590; U.S. Ser. No. 13/426,991 (U.S. Pat. No. 8,450, 471); U.S. Ser. No. 13/427,040 (U.S. Pat. No. 8,440,431); U.S. Ser. No. 13/427,137 (U.S. Pat. No. 8,440,432); and U.S. Ser. No. 13/738,381, all of which are incorporated by reference herein in their entirety. In addition, TALENS are described in WO 2015/027134, U.S. Pat. No. 9,181,535, Boch et al., "Breaking the Code of DNA Binding Specificity of TAL-Type III Effectors", Science, vol. 326, pp. 1509-1512 (2009), Bogdanove et al., TAL Effectors: Customizable Proteins for DNA Targeting, Science, vol. 333, pp. 1843-1846 (2011), Cade et al., "Highly efficient generation of heritable zebrafish gene mutations using homo- and heterodimeric TALENs", Nucleic Acids Research, vol. 40, pp. 8001-8010 (2012), and Cermak et al., "Efficient design and assembly of custom TALEN and other TAL effector-based constructs for DNA targeting", Nucleic Acids Research, vol. 39, No. 17, e82 (2011), each of which are incorporated herein by reference.

As represented in FIG. 1J, zinc finger nucleases may also be used as alternative programmable nucleases for use in prime editing in place of napDNAbps, such as Cas9 nickases. Like with TALENS, the ZFN proteins may be modified such that they function as nickases, i.e., engineering the ZFN such that it cleaves only one strand of the target DNA in a manner similar to the napDNAbp used with the prime editors described herein. ZFN proteins have been extensively described in the art, for example, in Carroll et al., "Genome Engineering with Zinc-Finger Nucleases," *Genetics*, August 2011, Vol. 188: 773-782; Dural et al., "Zinc finger nucleases: custom-designed molecular scissors for genome engineering of plant and mammalian cells," *Nucleic Acids Res*, 2005, Vol. 33: 5978-90; and Gaj et al., "ZFN, TALEN, and CRISPR/Cas-based methods for genome engineering," *Trends Biotechnol.* 2013, Vol. 31: 397-405, each of which are incorporated herein by reference in their entireties.

[3] Polymerases (e.g., Reverse Transcriptases)

In various embodiments, the prime editor (PE) system disclosed herein includes a polymerase (e.g., DNA-dependent DNA polymerase or RNA-dependent DNA polymerase, such as, reverse transcriptase), or a variant thereof, which can be provided as a fusion protein with a napDNAbp or other programmable nuclease, or provide in trans.

Any polymerase may be used in the prime editors disclosed herein. The polymerases may be wild type polymerases, functional fragments, mutants, variants, or truncated variants, and the like. The polymerases may include wild type polymerases from eukaryotic, prokaryotic, archael, or viral organisms, and/or the polymerases may be modified by genetic engineering, mutagenesis, directed evolution-based processes. The polymerases may include T7 DNA polymerase, T5 DNA polymerase, T4 DNA polymerase, Klenow fragment DNA polymerase, DNA polymerase III and the like. The polymerases may also be thermostable, and may include Taq, Tne, Tma, Pfu, Tfl, Tth, Stoffel fragment, VENT® and DEEPVENT® DNA polymerases, KOD, Tgo, JDF3, and mutants, variants and derivatives thereof (see U.S. Pat. Nos. 5,436,149; 4,889,818; 4,965,185; 5,079,352; 5,614,365; 5,374,553; 5,270,179; 5,047,342; 5,512,462; WO 92/06188; WO 92/06200; WO 96/10640; Barnes, W. M., Gene 112:29-35 (1992); Lawyer, F. C., et al., PCR Meth. Appl. 2:275-287 (1993); Flaman, J.-M, et al., Nuc. Acids Res. 22(15):3259-3260 (1994), each of which are incorporated by reference). For synthesis of longer nucleic acid molecules (e.g, nucleic acid molecules longer than about 3-5 Kb in length), at least two DNA polymerases can be employed. In certain embodiments, one of the polymerases can be substantially lacking a 3' exonuclease activity and the other may have a 3' exonuclease activity. Such pairings may include polymerases that are the same or different. Examples of DNA polymerases substantially lacking in 3' exonuclease activity include, but are not limited to, Taq, Tne(exo-), Tma(exo-), Pfu(exo-), Pwo (exo-), exo-KOD and Tth DNA polymerases, and mutants, variants and derivatives thereof.

Preferably, the polymerase usable in the prime editors disclosed herein are "template-dependent" polymerase (since the polymerases are intended to rely on the DNA synthesis template to specify the sequence of the DNA strand under synthesis during prime editing. As used herein, the term "template DNA molecule" refers to that strand of a nucleic acid from which a complementary nucleic acid strand is synthesized by a DNA polymerase, for example, in a primer extension reaction of the DNA synthesis template of a PEgRNA.

As used herein, the term "template dependent manner" is intended to refer to a process that involves the template dependent extension of a primer molecule (e.g., DNA synthesis by DNA polymerase). The term "template dependent manner" refers to polynucleotide synthesis of RNA or DNA wherein the sequence of the newly synthesized strand of polynucleotide is dictated by the well-known rules of complementary base pairing (see, for example, Watson, J. D. et al., In: Molecular Biology of the Gene, 4th Ed., W. A. Benjamin, Inc., Menlo Park, Calif. (1987)). The term "complementary" refers to the broad concept of sequence complementarity between regions of two polynucleotide strands or between two nucleotides through base-pairing. It is known that an adenine nucleotide is capable of forming specific hydrogen bonds ("base pairing") with a nucleotide which is thymine or uracil. Similarly, it is known that a cytosine nucleotide is capable of base pairing with a guanine nucleotide. As such, in the case of prime editing, it can be said that the single strand of DNA synthesized by the polymerase of the prime editor against the DNA synthesis template is said to be "complementary" to the sequence of the DNA synthesis template.

A. Exemplary Polymerases

In various embodiments, the prime editors described herein comprise a polymerase. The disclosure contemplates any wild type polymerase obtained from any naturally-occurring organim or virus, or obtained from a commercial or non-commercial source. In addition, the polymerases usable in the prime editors of the disclosure can include any naturally-occurring mutant polymerase, engineered mutant polymerase, or other variant polymerase, including truncated variants that retain function. The polymerases usable herein may also be engineered to contain specific amino acid substitutions, such as those specifically disclosed herein. In certain preferred embodiments, the polymerases usable in the prime editors of the disclosure are template-based polymerases, i.e., they synthesize nucleotide sequences in a template-dependent manner.

A polymerase is an enzyme that synthesizes a nucleotide strand and which may be used in connection with the prime editor systems described herein. The polymerases are preferrably "template-dependent" polymerases (i.e., a polymerase which synthesizes a nucleotide strand based on the order of nucleotide bases of a template strand). In certain configurations, the polymerases can also be a "template-independent" (i.e., a polymerase which synthesizes a nucleotide strand without the requirement of a template strand). A polymerase may also be further categorized as a "DNA polymerase" or an "RNA polymerase." In various embodiments, the prime editor system comprises a DNA polymerase. In various embodiments, the DNA polymerase can be a "DNA-dependent DNA polymerase" (i.e., whereby the template molecule is a strand of DNA). In such cases, the DNA template molecule can be a PEgRNA, wherein the extension arm comprises a strand of DNA. In such cases, the PEgRNA may be referred to as a chimeric or hybrid PEgRNA which comprises an RNA portion (i.e., the guide RNA components, including the spacer and the gRNA core) and a DNA portion (i.e., the extension arm). In various other embodiments, the DNA polymerase can be an "RNA-dependent DNA polymerase" (i.e., whereby the template molecule is a strand of RNA). In such cases, the PEgRNA is RNA, i.e., including an RNA extension. The term "polymerase" may also refer to an enzyme that catalyzes the polymerization of nucleotide (i.e., the polymerase activity). Generally, the enzyme will initiate synthesis at the 3'-end of a primer annealed to a polynucleotide template sequence (e.g., such as a primer sequence annealed to the primer binding site of a PEgRNA), and will proceed toward the 5' end of the template strand. A "DNA polymerase" catalyzes the polymerization of deoxynucleotides. As used herein in reference to a DNA polymerase, the term DNA polymerase includes a "functional fragment thereof". A "functional fragment thereof" refers to any portion of a wild-type or mutant DNA polymerase that encompasses less than the entire amino acid sequence of the polymerase and which retains the ability, under at least one set of conditions, to catalyze the polymerization of a polynucleotide. Such a functional fragment may exist as a separate entity, or it may be a constituent of a larger polypeptide, such as a fusion protein.

In some embodiments, the polymerases can be from bacteriophage. Bacteriophage DNA polymerases are generally devoid of 5' to 3' exonuclease activity, as this activity is encoded by a separate polypeptide. Examples of suitable DNA polymerases are T4, T7, and phi29 DNA polymerase. The enzymes available commercially are: T4 (available from many sources e.g., Epicentre) and T7 (available from many sources, e.g. Epicentre for unmodified and USB for 3' to 5' exo T7 "Sequenase" DNA polymerase).

The other embodiments, the polymerases are archaeal polymerases. There are 2 different classes of DNA polymerases which have been identified in archaea: 1. Family B/pol I type (homologs of Pfu from *Pyrococcus furiosus*) and 2. pol II type (homologs of *P. furiosus* DP1/DP2 2-subunit polymerase). DNA polymerases from both classes have been shown to naturally lack an associated 5' to 3' exonuclease activity and to possess 3' to 5' exonuclease (proofreading) activity. Suitable DNA polymerases (pol I or pol II) can be derived from archaea with optimal growth temperatures that are similar to the desired assay temperatures.

Thermostable archaeal DNA polymerases are isolated from *Pyrococcus* species (*furiosus*, species GB-D, woesii, abysii, horikoshii), *Thermococcus* species (*kodakaraensis* KOD1, litoralis, species 9 degrees North-7, species JDF-3, gorgonarius), *Pyrodictium occultum*, and *Archaeoglobus fulgidus*.

Polymerases may also be from eubacterial species. There are 3 classes of eubacterial DNA polymerases, pol I, II, and III. Enzymes in the Pol I DNA polymerase family possess 5' to 3' exonuclease activity, and certain members also exhibit 3' to 5' exonuclease activity. Pol II DNA polymerases naturally lack 5' to 3' exonuclease activity, but do exhibit 3' to 5' exonuclease activity. Pol III DNA polymerases represent the major replicative DNA polymerase of the cell and are composed of multiple subunits. The pol III catalytic subunit lacks 5' to 3' exonuclease activity, but in some cases 3' to 5' exonuclease activity is located in the same polypeptide.

There are a variety of commercially available Pol I DNA polymerases, some of which have been modified to reduce or abolish 5' to 3' exonuclease activity.

Suitable thermostable pol I DNA polymerases can be isolated from a variety of thermophilic eubacteria, including *Thermus* species and *Thermotoga maritima* such as *Thermus aquaticus* (Taq), *Thermus thermophilus* (Tth) and *Thermotoga maritima* (Tma UlTma).

Additional eubacteria related to those listed above are described in Thermophilic Bacteria (Kristjansson, J. K., ed.) CRC Press, Inc., Boca Raton, Fla., 1992.

The invention further provides for chimeric or non-chimeric DNA polymerases that are chemically modified according to methods disclosed in U.S. Pat. Nos. 5,677,152, 6,479,264 and 6,183,998, the contents of which are hereby incorporated by reference in their entirety.

Additional archaea DNA polymerases related to those listed above are described in the following references: Archaea: A Laboratory Manual (Robb, F. T. and Place, A. R., eds.), Cold Spring Harbor Laboratory Press, Cold Spring

B. Exemplary Reverse Transcriptases

In various embodiments, the prime editors described herein comprise a reverse transcriptase as the polymerase. The disclosure contemplates any wild type reverse transcriptase obtained from any naturally-occurring organim or virus, or obtained from a commercial or non-commercial source. In addition, the reverse transcriptases usable in the prime editors of the disclosure can include any naturally-occurring mutant RT, engineered mutant RT, or other variant RT, including truncated variants that retain function. The RTs may also be engineered to contain specific amino acid substitutions, such as those specifically disclosed herein.

Reverse transcriptases are multi-functional enzymes typically with three enzymatic activities including RNA- and DNA-dependent DNA polymerization activity, and an RNaseH activity that catalyzes the cleavage of RNA in RNA-DNA hybrids. Some mutants of reverse transcriptases have disabled the RNaseH moiety to prevent unintended damage to the mRNA. These enzymes that synthesize complementary DNA (cDNA) using mRNA as a template were first identified in RNA viruses. Subsequently, reverse transcriptases were isolated and purified directly from virus particles, cells or tissues. (e.g., see Kacian et al., 1971, Biochim. Biophys. Acta 46: 365-83; Yang et al., 1972, Biochem. Biophys. Res. Comm. 47: 505-11; Gerard et al., 1975, J. Virol. 15: 785-97; Liu et al., 1977, Arch. Virol. 55 187-200; Kato et al., 1984, J. Virol. Methods 9: 325-39; Luke et al., 1990, Biochem. 29: 1764-69 and Le Grice et al., 1991, J. Virol. 65: 7004-07, each of which are incorporated by reference). More recently, mutants and fusion proteins have been created in the quest for improved properties such as thermostability, fidelity and activity. Any of the wild type, variant, and/or mutant forms of reverse transcriptase which are known in the art or which can be made using methods known in the art are contemplated herein.

The reverse transcriptase (RT) gene (or the genetic information contained therein) can be obtained from a number of different sources. For instance, the gene may be obtained from eukaryotic cells which are infected with retrovirus, or from a number of plasmids which contain either a portion of or the entire retrovirus genome. In addition, messenger RNA-like RNA which contains the RT gene can be obtained from retroviruses. Examples of sources for RT include, but are not limited to, Moloney murine leukemia virus (M-MLV or MLVRT); human T-cell leukemia virus type 1 (HTLV-1); bovine leukemia virus (BLV); Rous Sarcoma Virus (RSV); human immunodeficiency virus (HIV); yeast, including *Saccharomyces, Neurospora, Drosophila*; primates; and rodents. See, for example, Weiss, et al., U.S. Pat. No. 4,663,290 (1987); Gerard, G. R., DNA:271-79 (1986); Kotewicz, M. L., et al., Gene 35:249-58 (1985); Tanese, N., et al., Proc. Natl. Acad. Sci. (USA):4944-48 (1985); Roth, M. J., at al., J. Biol. Chem. 260:9326-35 (1985); Michel, F., et al., Nature 316:641-43 (1985); Akins, R. A., et al., Cell 47:505-16 (1986), *EMBO J.* 4:1267-75 (1985); and Fawcett, D. F., Cell 47:1007-15 (1986) (each of which are incorporated herein by reference in their entireties).

Wild Type RTs

Exemplary enzymes for use with the herein disclosed prime editors can include, but are not limited to, M-MLV reverse transcriptase and RSV reverse transcriptase. Enzymes having reverse transcriptase activity are commercially available. In certain embodiments, the reverse transcriptase provided in trans to the other components of the prime editor (PE) system. That is, the reverse transcriptase is expressed or otherwise provided as an individual component, i.e., not as a fusion protein with a napDNAbp.

A person of ordinary skill in the art will recognize that wild type reverse transcriptases, including but not limited to, Moloney Murine Leukemia Virus (M-MLV); Human Immunodeficiency Virus (HIV) reverse transcriptase and avian Sarcoma-Leukosis Virus (ASLV) reverse transcriptase, which includes but is not limited to Rous Sarcoma Virus (RSV) reverse transcriptase, Avian Myeloblastosis Virus (AMV) reverse transcriptase, Avian Erythroblastosis Virus (AEV) Helper Virus MCAV reverse transcriptase, Avian Myelocytomatosis Virus MC29 Helper Virus MCAV reverse transcriptase, Avian Reticuloendotheliosis Virus (REV-T) Helper Virus REV-A reverse transcriptase, Avian Sarcoma Virus UR2 Helper Virus UR2AV reverse transcriptase, Avian Sarcoma Virus Y73 Helper Virus YAV reverse transcriptase, Rous Associated Virus (RAV) reverse transcriptase, and Myeloblastosis Associated Virus (MAV) reverse transcriptase may be suitably used in the subject methods and composition described herein.

Exemplary wild type RT enzymes are as follows:

| DESCRIPTION | SEQUENCE |
|---|---|
| REVERSE TRANSCRIPTASE (M-MLV RT) WILD TYPE MOLONEY MURINE LEUKEMIA VIRUS USED IN PE1 (PRIME EDITOR 1 FUSION PROTEIN DISCLOSED HEREIN) | TLNIEDEYRLHETSKEPDVSLGSTWLSDFPQAWAETGGMGLA VRQAPLIIPLKATSTPVSIKQYPMSQEARLGIKPHIQRLLDQGIL VPCQSPWNTPLLPVKKPGTNDYRPVQDLREVNKRVEDIHPTV PNPYNLLSGLPPSHQWYTVLDLKDAFFCLRLHPTSQPLFAFEW RDPEMGISGQLTWTRLPQGFKNSPTLFDEALHRDLADFRIQHP DLILLQYVDDLLLAATSELDCQQGTRALLQTLGNLGYRASAK KAQICQKQVKYLGYLLKEGQRWLTEARKETVMGQPTPKTPR QLREFLGTAGFCRLWIPGFAEMAAPLYPLTKTGTLFNWGPDQ QKAYQEIKQALLTAPALGLPDLTKPFELFVDEKQGYAKGVLTQ KLGPWRRPVAYLSKKLDPVAAGWPPCLRMVAAIAVLTKDAGK LTMGQPLVILAPHAVEALVKQPPDRWLSNARMTHYQALLLDT DRVQFGPVVALNPATLLPLPEEGLQHNCLDILAEAHGTRPDLT DQPLPDADHTWYTDGSSLLQEGQRKAGAAVTTETEVIWAKA LPAGTSAQRAELIALTQALKMAEGKKLNVYTDSRYAFATAHIH GEIYRRRGLLTSEGKEIKNKDEILALLKALFLPKRLSIIHCPGHQ KGHSAEARGNRMADQAARKAAITETPDTSTLLIENSSP (SEQ ID NO: 89) |
| REVERSE TRANSCRIPTASE MOLONEY MURINE LEUKEMIA VIRUS | AFPLERPDWDYTTQAGRNHLVHYRQLLLAGLQNAGRSPTNL AKVKGITQGPNESPSAFLERLKEAYRRYTPYDPEDPGQETNVS MSFIWQSAPDIGRKLGRLEDLKSKTLGDLVREAEKIFNKRETP EEREERIRRETEEKEERRRTVDEQKEKERDRRRHREMSKLLAT |

-continued

| DESCRIPTION | SEQUENCE |
| --- | --- |
| REF SEQ. AAA66622.1 | VVIGQEQDRQEGERKRPQLDKDQCAYCKEKGHWAKDCPKKP RGPRGPRPQTSLLTLGDXGGQGQDPPPEPRITLKVGGQPVTFL VDTGAQHVSVLTQNPGPLSDKSAWVQGATGGKRYRWTTDRKV HLATGKVTHSFLHVPDCPYPLLGRDLLTKLKAQIHFEGSGAQV VGPMGQPLQVLTLNIEDEYRLHETSKEPDVSLGFTWLSDFPQA WAESGGMGLAVRQAPLIIPLKATSTPVSIKQYPMSQEARLGIKP HIQRLLDQGILVPCQSPWNTPLLPVKKPGTNDYRPVQDLREV NKRVEDIHPTVPNPYNLLSGLPPSHQWYTVLDLKDAFFCLRL HPTSQPLFAFEWRDPEMGISGQLTWTRLPQGFKNSPTLFDEAL HRDLADFR (SEQ ID NO: 90) |
| REVERSE TRANSCRIPTASE FELINE LEUKEMIA VIRUS REF SEQ. NP955579.1 | TLQLEEEYRLFEPESTQKQEMDIWLKNFPQAWAETGGMGTAH CQAPVLIQLKATATPISIRQYPMPHEAYQGIKPHIRRMLDQGIL KPCQSPWNTPLLPVKKPGTEDYRPVQDLREVNKRVEDIHPTV PNPYNLLSTLPPSHPWYTVLDLKDAFFCLRLHSESQLLFAFEW RDPEIGLSGQLTWTRLPQGFKNSPTLFDEALHSDLADFRVRYP ALVLLQYVDDLLLAAATRTECLEGTKALLETLGNKGYRASAK KAQICLQEVTYLGYSLKDGQRWLTKARKEAILSIPVPKNSRQV REFLGTAGYCRLWIPGFAELAAPLYPLTRPGTLFQWGTEQQLA FEDIKKALLSSPALGLPDITKPFELFIDENSGFAKGVLVQKLGP WKRPVAYLSKKLDTVASGWPPCLRMVAAIAILVKDAGKLTLG QPLTILTSHPVEALVRQPPNKWLSNARMTHYQAMLLDAERVH FGPTVSLNPATLLPLPSGGNHHDCLQILAETHGTRPDLTDQPLP DADLTWYTDGSSFIRNGEREAGAAVTTESEVIWAAPLPPGTSA QRAELIALTQALKMAEGKKLTVYTDSRYAFATTHVHGEIYRRR GLLTSEGKEIKNKNEILALLEALFLPKRLSIIHCPGHQKGDSPQ AKGNRLADDTAKKAATETHSSLTVL SEQ ID NO: 91) |
| REVERSE TRANSCRIPTASE HIV-1 RT, CHAIN A REF SEQ. ITL3-A | PISPIETVPVKLKPGMDGPKVKQWPLTEEKIKALVEICTEMEKE GKISKIGPENPYNTPVFAIKKKDSTKWRKLVDFRELNKRTQDF WEVQLGIPHPAGLKKKKSVTVLDVGDAYFSVPLDEDFRKYTA FTIPSINNETPGIRYQYNVLPQGWKGSPAIFQSSMTKILEPFRKQ NPDIVIYQYMDDLYVGSDLEIGQHRTKIEELRQHLLRWGLTTP DKKHQKEPPFLWMGYELHPDKWTVQPIVLPEKDSWTVNDIQ KLVGKLNWASQIYPGIKVRQLXKLLRGTKALTEVIPLTEEAEL ELAENREILKEPVHGVYYDPSKDLIAEIQKQGQGQWTYQIYQ EPFKNLKTGKYARMRGAHTNDVKQLTEAVQKITTESIVIWGK TPKFKLPIQKETWETWWTEYWQATWIPEWEFVNTPPLVKLW YQLEKEPIVGAETFYVDGAANRETKLGKAGYVTNRGRQKVV TLTDTTNQKTELQAIYLALQDSGLEVNIVTDSQYALGIIQAQPD QSESELVNQIIEQLIKKEKVYLAWVPAHKGIGGNEQVDKLVSA GIRKV (SEQ ID NO: 92) SEE MARTINELLI ET AL., VIROLOGY, 1990, 174(1): 135-144, WHICH IS INCORPORATED BY REFERENCE |
| REVERSE TRANSCRIPTASE HIV-1 RT, CHAIN B REF SEQ. ITL3-B | PISPIETVPVKLKPGMDGPKVKQWPLTEEKIKALVEICTEMEKE GKISKIGPENPYNTPVFAIKKKDSTKWRKLVDFRELNKRTQDF WEVQLGIPHPAGLKKKKSVTVLDVGDAYFSVPLDEDFRKYTA FTIPSINNETPGIRYQYNVLPQGWKGSPAIFQSSMTKILEPFRKQ NPDIVIYQYMDDLYVGSDLEIGQHRTKIEELRQHLLRWGLTTP DKKHQKEPPFLWMGYELHPDKWTVQPIVLPEKDSWTVNDIQ KLVGKLNWASQIYPGIKVRQLCKLLRGTKALTEVIPLTEEAELE LAENREILKEPVHGVYYDPSKDLIAEIQKQGQGQWTYQIYQEP FKNLKTGKYARMRGAHTNDVKQLTEAVQKITTESIVIWGKTP KFKLPIQKETWETWWTEYWQATWIPEWEFVNTPPLVKLWYQ LEKEPIVGAETF (SEQ ID NO: 93) SEE STAMMERS ET AL., J. MOL. BIOL., 1994, 242(4): 586-588, WHICH IS INCORPORATED BY REFERENCE |
| REVERSE TRANSCRIPTASE ROUS SARCOMA VIRUS RT REF SEQ. ACL14945 | TVALHLAIPLKWKPNHTPVWIDQWPLPEGKLVALTQLVEKEL QLGHIEPSLSCWNTPVFVIRKASGSYRLLHDLRAVNAKLVPFG AVQQGAPVLSALPRGWPLMVLDLKDCFFSIPLAEQDREAFAF TLPSVNNQAPARRFQWKVLPQGMTCSPTICQLIVGQILEPLRL KHPSLRMLHYMDDLLLAASSHDGLEAAGEEVISTLERAGFTIS PDKVQKEPGVQYLGYKLGSTYAAPVGLVAEPRIATLWDVQKL VGSLQWLRPALGIPPRLRGPFYEQLRGSDPNEAREWNLDMK MAWREIVQLSTTAALERWDPALPLEGAVARCEQGAIGVLGQG LSTHPRPCLWLFSTQPTKAFTAWLEVLTLLITKLRASAVRTFGK EVDDILLLPACFRDELPLPEGILLALRGFAGKIRSSDTPSIFDIARP LHVSLKVRVTDHPVPGPTVFTDASSSTHKGVVVWREGPRWEI KEIADLGASVQQLEARAVAMALLLWPTTPTNVVTDSAFVAKM LLKMGQEGVPSTAAAFILEDALSQRSAMAAVLHVRSHSEVPG FFTEGNDVADSQATFQAYPLREAKDLHTALHIGPRALSKACNI SMQQAREVVQTCPHCNSAPALEAGVNPRGLGPLQIWQTDFTL EPRMAPRSWLAVTVDTASSAIVVTQHGRVTSVAAQHHWATVI AVLGRPKAIKTDNGSCFTSKSTREWLARWGIAHTTGIPGNSQG |

| DESCRIPTION | SEQUENCE |
| --- | --- |
| | QAMVERANRLLKDKIRVLAEGDGFMKRIPTSKQGELLAKAM<br>YALNHFERGENTKTPIQKHWRPTVLTEGPPVKIRIETGEWEKG<br>WNVLVWGRGYAAVKNRDTDKVIWVPSRKVKPDIAQKDEVT<br>KKDEASPLFA (SEQ ID NO: 94)<br>SEE YASUKAWA ET AL., J. BIOCHEM. 2009, 145(3): 315-324,<br>WHICH IS INCORPORATED BY REFERENCE |
| REVERSE<br>TRANSCRIPTASE<br>CAULIFLOWER<br>MOSAIC VIRUS RT<br>REF SEQ. AGT42196 | MMDHLLQKTQIQNQTEQVMNITNPNSIYIKGRLYFKGYKKIEL<br>HCFVDTGASLCIASKFVIPEEHWINAERPHVIVKIADGSSITINKV<br>CRDIDLIIAGEIFHIPTVYQQESGIDFIIGNNFCQLYEPFIQFTDRV<br>TTKDRTYPVHIAKLTRAVRVGTEGFLESMKKRSKTQQPEPVNI<br>STNKIAILSEGRRLSEEKLFITQQRMQKIEELLEKVCSENPLDP<br>NKTKQWMKASIKLSDPSKAIKVKPMKYSPMDREEFDKQIKEL<br>LDLKVIKPSKSPHMAPAFLVNNEAEKRRGKKRMVVNYKAMN<br>KATVGDAYNLPNKDELLTLIRGKKIFSSFDCKSGFWQVLLDQD<br>SRPLTAFTCPQGHYEWNVVPFGLKQAPSIFQRHMDEAFRVFR<br>KFCCVYVDDILVFSNNEEDHLLHVAMILQKCNQHGIILSKKKA<br>QLFKKKINFLGLEIDEGTHKPQGHILEHINKFPDTLEDKKQLQR<br>FLGILTYASDYIPKLAQIRKPLQAKLKENVPWKWTKEDTLYM<br>QKVKKNLQGFPPLHHPLPEEKLIIETDASDDYWGGMLKAIKIN<br>EGTNTELICRYASGSFKAAEKNYHSNDKETLAVINTIKKFSIYL<br>TPVHFLIRTDNTHFKSFVNLNYKGDSKLGRNIRWQAWLSHYS<br>FDVEHIKGTDNHFADFLSREFNRVNS (SEQ ID NO: 95)<br>SEE FARZADFAR ET AL., VIRUS GENES, 2013, 47(2): 347-356,<br>WHICH IS INCORPORATED BY REFERENCE |
| REVERSE<br>TRANSCRIPTASE<br>*KLEBSIELLA*<br>*PNEUMONIA*<br>REF SEQ. RFF81513.1 | MKEKISKIDKNFYTDIFIKTSFQNEFEAGGVIPPIAKNQVSTISN<br>KNKTFYSLAHSSPHYSIQTRIEKFLLKNIPLSASSFAFRKERSYL<br>HYLEPHTQNVKYCHLDIVSFFHSIDVNIVRDTFSVYFSDEFLVK<br>EKQSLLDAFMASVTLTAELDGVEKTFIPMGFKSSPSISNIIFRKI<br>DILIQKFCDKNKITYTRYADDLLFSTKKENNILSSTFFINEISSIL<br>SINTKFKLNKSKYLYKEGTISLGGYVIENILKDNSSGNIRLSSSKL<br>NPLYKALYEIKKGSSSKHICIKVFNLKLKRFIYKKNKEKFEAKF<br>YSSQLKNKLLGYRSYLLSFVIFHKKYKCINPIFLEKCVFLISEIE<br>SIEVINRKF (SEQ ID NO: 96) |
| REVERSE<br>TRANSCRIPTASE<br>*ESCERICHIA COLI*<br>RT<br>REF SEQ. TGH57013 | MKITSNNVTAVINGKGWHSINWKKCHQHVKTIQTRIAKAACN<br>QQWRTVGRLQRLLVRSFSARALAVKRVTENSGRKTPGVDGQI<br>WSTPESKWEATKLRRKGYKPLPLKRVFIPKSNGKKRPLGIPV<br>MLDRAMQALHLLGLEPVSETNADHNSYGFRPARCTADAIQQ<br>VCNMYSSRNASKWVLEGDIKGCFEHISHEWLLENIPMDKQIL<br>RNWLKAGIIEKSIFSKTLSGTPQGGIISPVLANMALDGLERLLQ<br>NRFGRNRLI (SEQ ID NO: 97) |
| REVERSE<br>TRANSCRIPTASE<br>*BACILLUS SUBTILIS*<br>RT<br>REF SEQ. QBJ66766 | MSKIKINYEKYHIKPFPHFDQRIKVNKKVKENLQNPFYIAAHS<br>FYPFIHYKKISYKFKNGTLSSPKERDIFYSGHMDGYIYKHYGEI<br>LNHKYNNTCIGKGIDHVSLAYRNNKMGKSNIHFAAEVINFISE<br>QQQAFIFVSDFSSYFDSLDHAILKEKLIEVLEEQDKLSKDWWN<br>VFKHITRYNWVEKEEVISDLECTKEKIARDKKSRERYYTPAEF<br>REFRKRVNIKSNDTGVGIPQGTAISAVLANVYAIDLDQKLNQY<br>ALKYGGIYRRYSDDIIMVLPMTSDGQDPSNDHVSFIKSVVKRN<br>KVTMGDSKTSVLYYANNNIYEDYQRKRESKMDYLGFSFDGM<br>TVKIREKSLFKYYHRTYKKINSINWASVKKEKKVGRKKLYLL<br>YSHLGRNYKGHGNFISYCKKAHAVFEGNKKIESLINQQIKRH<br>WKKIQKRLVDV (SEQ ID NO: 98) |
| *EUBACTERIUM*<br>*RECTALE* GROUP II<br>INTRON RT | DTSNLMEQILSSDNLNRAYLQVVRNKGAEGVDGMKYTELKE<br>HLAKNGETIKGQLRTRKYKPQPARRVEIPKPDGGVRNLGVPT<br>VTDRFIQQAIAQVLTPIYEEQFHDHSYGFRPNRCAQQAILTALN<br>IMNDGNDWIVDIDLEKFFDTVNHDKLMTLIGRTIKDGDVISIV<br>RKYLVSGIMIDDEYEDSIVGTPQGGNLSPLLANIMLNELDKEM<br>EKRGLNFVRYADDCIIMVGSEMSANRVMRNISRFIEEKLGLKV<br>NMTKSKVDRPSGLKYLGFGFYFDPRAHQFKAKPHAKSVAKF<br>KKRMKELTCRSWGVSNSYKVEKLNQLIRGWINYFKIGSMKTL<br>CKELDSRIRYRLRMCIWKQWKTPQNQEKNLVKLGIDRNTARR<br>VAYTGKRIAYVCNKGAVNVAISNKRLASFGLISMLDYYIEKCV<br>TC (SEQ ID NO: 99) |
| *GEOBACILLUS*<br>*STEAROTHERMOPHILUS*<br>GROUP II<br>INTRON RT | ALLERILARDNLITALKRVEANQGAPGIDGVSTDQLRDYIRAH<br>WSTIHAQLLAGTYRPAPVRRVEIPKPGGGTRQLGIPTVVDRLIQ<br>QAILQELTPIFDPDFSSSSFGFRPGRNAHDAVRQAQGYIQEGYR<br>YVVDMDLEKFFDRVNHDILMSRVARKVKDKRVLKLIRAYLQA<br>GVMIEGVKVQTEEGTPQGGPLSPLLANILLDDLDKELEKRGL<br>KFCRYADDCNIYVKSLRAGQRVKQSIQRFLEKTLKLKVNEEKS<br>AVDRPWKRAFLGFSFTPERKARIRLAPRSIQRLKQRIRQLTNPN<br>WSISMPERIHRVNQYVMGWIGYFRLVETPSVLQTIEGWIRRRL |

| DESCRIPTION | SEQUENCE |
|---|---|
| | RLCQWLQWKRVRTRIRELRALGLKETAVMEIANTRKGAWRTT KTPQLHQALGKTYWTAQGLKSLTQR (SEQ ID NO: 100) |

Variant and Error-Prone RTs

Reverse transcriptases are essential for synthesizing complementary DNA (cDNA) strands from RNA templates. Reverse transcriptases are enzymes composed of distinct domains that exhibit different biochemical activities. The enzymes catalyze the synthesis of DNA from an RNA template, as follows: In the presence of an annealed primer, reverse transcriptase binds to an RNA template and initiates the polymerization reaction. RNA-dependent DNA polymerase activity synthesizes the complementary DNA (cDNA) strand, incorporating dNTPs. RNase H activity degrades the RNA template of the DNA:RNA complex. Thus, reverse transcriptases comprise (a) a binding activity that recognizes and binds to a RNA/DNA hybrid, (b) an RNA-dependent DNA polymerase activity, and (c) an RNase H activity. In addition, reverse transcriptases generally are regarded as having various attributes, including their thermostability, processivity (rate of dNTP incorporation), and fidelity (or error-rate). The reverse transcriptase variants contemplated herein may include any mutations to reverse transcriptase that impacts or changes any one or more of these enzymatic activities (e.g., RNA-dependent DNA polymerase activity, RNase H activity, or DNA/RNA hybrid-binding activity) or enzyme properties (e.g., thermostability, processivity, or fidelity). Such variants may be available in the art in the public domain, available commercially, or may be made using known methods of mutagenesis, including directed evolutionary processes (e.g., PACE or PANCE).

In various embodiments, the reverse transcriptase may be a variant reverse transcriptase. As used herein, a "variant reverse transcriptase" includes any naturally occurring or genetically engineered variant comprising one or more mutations (including singular mutations, inversions, deletions, insertions, and rearrangements) relative to a reference sequences (e.g., a reference wild type sequence). RT naturally have several activities, including an RNA-dependent DNA polymerase activity, ribonuclease H activity, and DNA-dependent DNA polymerase activity. Collectively, these activities enable the enzyme to convert single-stranded RNA into double-stranded cDNA. In retroviruses and retrotransposons, this cDNA can then integrate into the host genome, from which new RNA copies can be made via host-cell transcription. Variant RT's may comprise a mutation which impacts one or more of these activities (either which reduces or increases these activities, or which eliminates these activities all together). In addition, variant RTs may comprise one or more mutations which render the RT more or less stable, less prone to aggregration, and facilitates purification and/or detection, and/or other the modification of properties or characteristics.

A person of ordinary skill in the art will recognize that variant reverse transcriptases derived from other reverse transcriptases, including but not limited to Moloney Murine Leukemia Virus (M-MLV); Human Immunodeficiency Virus (HIV) reverse transcriptase and avian Sarcoma-Leukosis Virus (ASLV) reverse transcriptase, which includes but is not limited to Rous Sarcoma Virus (RSV) reverse transcriptase, Avian Myeloblastosis Virus (AMV) reverse transcriptase, Avian Erythroblastosis Virus (AEV) Helper Virus MCAV reverse transcriptase, Avian Myelocytomatosis Virus MC29 Helper Virus MCAV reverse transcriptase, Avian Reticuloendotheliosis Virus (REV-T) Helper Virus REV-A reverse transcriptase, Avian Sarcoma Virus UR2 Helper Virus UR2AV reverse transcriptase, Avian Sarcoma Virus Y73 Helper Virus YAV reverse transcriptase, Rous Associated Virus (RAV) reverse transcriptase, and Myeloblastosis Associated Virus (MAV) reverse transcriptase may be suitably used in the subject methods and composition described herein.

One method of preparing variant RTs is by genetic modification (e.g., by modifying the DNA sequence of a wild-type reverse transcriptase). A number of methods are known in the art that permit the random as well as targeted mutation of DNA sequences (see for example, Ausubel et. al. *Short Protocols in Molecular Biology* (1995) 3.sup.rd Ed. John Wiley & Sons, Inc.). In addition, there are a number of commercially available kits for site-directed mutagenesis, including both conventional and PCR-based methods. Examples include the QuikChange Site-Directed Mutagenesis Kits (AGILENT®), the Q5® Site-Directed Mutagenesis Kit (NEW ENGLAND BIOLABS®), and GeneArt™ Site-Directed Mutagenesis System (THERMOFISHER SCIENTIFIC®).

In addition, mutant reverse transcriptases may be generated by insertional mutation or truncation (N-terminal, internal, or C-terminal insertions or truncations) according to methodologies known to one skilled in the art. The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Because of their nature, gain-of-function mutations are usually dominant.

Older methods of site-directed mutagenesis known in the art rely on sub-cloning of the sequence to be mutated into a vector, such as an M13 bacteriophage vector, that allows the isolation of single-stranded DNA template. In these methods, one anneals a mutagenic primer (i.e., a primer capable of annealing to the site to be mutated but bearing one or more mismatched nucleotides at the site to be mutated) to the single-stranded template and then polymerizes the complement of the template starting from the 3' end of the mutagenic primer. The resulting duplexes are then transformed into host bacteria and plaques are screened for the desired mutation.

More recently, site-directed mutagenesis has employed PCR methodologies, which have the advantage of not requiring a single-stranded template. In addition, methods have been developed that do not require sub-cloning. Several issues must be considered when PCR-based site-directed mutagenesis is performed. First, in these methods it is desirable to reduce the number of PCR cycles to prevent expansion of undesired mutations introduced by the polymerase. Second, a selection must be employed in order to reduce the number of non-mutated parental molecules persisting in the reaction. Third, an extended-length PCR method is preferred in order to allow the use of a single PCR primer set. And fourth, because of the non-template-dependent terminal extension activity of some thermostable polymerases it is often necessary to incorporate an end-polishing step into the procedure prior to blunt-end ligation of the PCR-generated mutant product.

Methods of random mutagenesis, which will result in a panel of mutants bearing one or more randomly situated mutations, exist in the art. Such a panel of mutants may then be screened for those exhibiting the desired properties, for example, increased stability, relative to a wild-type reverse transcriptase.

An example of a method for random mutagenesis is the so-called "error-prone PCR method." As the name implies, the method amplifies a given sequence under conditions in which the DNA polymerase does not support high fidelity incorporation. Although the conditions encouraging error-prone incorporation for different DNA polymerases vary, one skilled in the art may determine such conditions for a given enzyme. A key variable for many DNA polymerases in the fidelity of amplification is, for example, the type and concentration of divalent metal ion in the buffer. The use of manganese ion and/or variation of the magnesium or manganese ion concentration may therefore be applied to influence the error rate of the polymerase.

In various aspects, the RT of the prime editors may be an "error-prone" reverse transcriptase variant. Error-prone reverse transcriptases that are known and/or available in the art may be used. It will be appreciated that reverse transcriptases naturally do not have any proofreading function; thus the error rate of reverse transcriptase is generally higher than DNA polymerases comprising a proofreading activity. The error-rate of any particular reverse transcriptase is a property of the enzyme's "fidelity," which represents the accuracy of template-directed polymerization of DNA against its RNA template. An RT with high fidelity has a low-error rate. Conversely, an RT with low fidelity has a high-error rate. The fidelity of M-MLV-based reverse transcriptases are reported to have an error rate in the range of one error in 15,000 to 27,000 nucleotides synthesized. See Boutabout et al., "DNA synthesis fidelity by the reverse transcriptase of the yeast retrotransposon Ty1," Nucleic Acids Res, 2001, 29: 2217-2222, which is incorporated by reference. Thus, for purposes of this application, those reverse transcriptases considered to be "error-prone" or which are considered to have an "error-prone fidelity" are those having an error rate that is less than one error in 15,000 nucleotides synthesized.

Error-prone reverse transcriptase also may be created through mutagenesis of a starting RT enzyme (e.g., a wild type M-MLV RT). The method of mutagenesis is not limited and may include directed evolution processes, such as phage-assisted continuous evolution (PACE) or phage-assisted noncontinuous evolution (PANCE). The term "phage-assisted continuous evolution (PACE)," as used herein, refers to continuous evolution that employs phage as viral vectors. The general concept of PACE technology has been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015, International PCT Application, PCT/US2015/012022, filed Jan. 20, 2015, published as WO 2015/134121 on Sep. 11, 2015, and International PCT Application, PCT/US2016/027795, filed Apr. 15, 2016, published as WO 2016/168631 on Oct. 20, 2016, the entire contents of each of which are incorporated herein by reference.

Error-prone reverse transcriptases may also be obtain by phage-assisted non-continuous evolution (PANCE)," which as used herein, refers to non-continuous evolution that employs phage as viral vectors. PANCE is a simplified technique for rapid in vivo directed evolution using serial flask transfers of evolving 'selection phage' (SP), which contain a gene of interest to be evolved, across fresh E. coli host cells, thereby allowing genes inside the host E. coli to be held constant while genes contained in the SP continuously evolve. Serial flask transfers have long served as a widely-accessible approach for laboratory evolution of microbes, and, more recently, analogous approaches have been developed for bacteriophage evolution. The PANCE system features lower stringency than the PACE system.

Other error-prone reverse transcriptases have been described in the literature, each of which are contemplated for use in the herein methods and compositions. For example, error-prone reverse transcriptases have been described in Bebenek et al., "Error-prone Polymerization by HIV-1 Reverse Transcriptase," *J Biol Chem*, 1993, Vol. 268: 10324-10334 and Sebastian-Martin et al., "Transcriptional inaccuracy threshold attenuates differences in RNA-dependent DNA synthesis fidelity between retroviral reverse transcriptases," *Scientific Reports*, 2018, Vol. 8: 627, each of which are incorporated by reference. Still further, reverse transcriptases, including error-prone reverse transcriptases can be obtained from a commercial supplier, including ProtoScript® (II) Reverse Transcriptase, AMV Reverse Transcriptase, WarmStart® Reverse Transcriptase, and M-MuLV Reverse Transcriptase, all from NEW ENGLAND BIOLABS®, or AMV Reverse Transcriptase XL, SMARTScribe Reverse Transcriptase, GPR ultra-pure MMLV Reverse Transcriptase, all from TAKARA BIO USA, INC. (formerly CLONTECH).

The herein disclosure also contemplates reverse transcriptases having mutations in RNaseH domain. As mentioned above, one of the intrinsic properties of reverse transcriptases is the RNase H activity, which cleaves the RNA template of the RNA:cDNA hybrid concurrently with polymerization. The RNase H activity can be undesirable for synthesis of long cDNAs because the RNA template may be degraded before completion of full-length reverse transcription. The RNase H activity may also lower reverse transcription efficiency, presumably due to its competition with the polymerase activity of the enzyme. Thus, the present disclosure contemplates any reverse transcriptase variants that comprise a modified RNaseH activity.

The herein disclosure also contemplates reverse transcriptases having mutations in the RNA-dependent DNA polymerase domain. As mentioned above, one of the intrinsic properties of reverse transcriptases is the RNA-dependent DNA polymerase activity, which incorporates the nucleobases into the nascent cDNA strand as coded by the template RNA strand of the RNA:cDNA hybrid. The RNA-dependent DNA polymerase activity can be increased or decreased (i.e., in terms of its rate of incorporation) to either increase or decrease the processivity of the enzyme. Thus, the present disclosure contemplates any reverse transcriptase variants that comprise a modified RNA-dependent DNA polymerase activity such that the processivity of the enzyme of either increased or decreased relative to an unmodified version.

Also contemplated herein are reverse transcriptase variants that have altered thermostability characteristics. The ability of a reverse transcriptase to withstand high temperatures is an important aspect of cDNA synthesis. Elevated reaction temperatures help denature RNA with strong secondary structures and/or high GC content, allowing reverse transcriptases to read through the sequence. As a result, reverse transcription at higher temperatures enables full-length cDNA synthesis and higher yields, which can lead to an improved generation of the 3' flap ssDNA as a result of the prime editing process. Wild type M-MLV reverse transcriptase typically has an optimal temperature in the range of 37-48° C.; however, mutations may be introduced that allow for the reverse transcription activity at higher temperatures of over 48° C., including 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., and higher.

The variant reverse transcriptases contemplated herein, including error-prone RTs, thermostable RTs, increase-processivity RTs, can be engineered by various routine strategies, including mutagenesis or evolutionary processes. In some cases, the variants can be produced by introducing a single mutation. In other cases, the variants may require more than one mutation. For those mutants comprising more than one mutation, the effect of a given mutation may be evaluated by introduction of the identified mutation to the wild-type gene by site-directed mutagenesis in isolation from the other mutations borne by the particular mutant. Screening assays of the single mutant thus produced will then allow the determination of the effect of that mutation alone.

Variant RT enzymes used herein may also include other "RT variants" having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference RT protein, including any wild type RT, or mutant RT, or fragment RT, or other variant of RT disclosed or contemplated herein or known in the art.

In some embodiments, an RT variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or up to 100, or up to 200, or up to 300, or up to 400, or up to 500 or more amino acid changes compared to a reference RT. In some embodiments, the RT variant comprises a fragment of a reference RT, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of the reference RT. In some embodiments, the fragment is is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type RT (M-MLV reverse transcriptase) (e.g., SEQ ID NO: 89) or to any of the reverse transcriptases of SEQ ID NOs: 90-100.

In some embodiments, the disclosure also may utilize RT fragments which retain their functionality and which are fragments of any herein disclosed RT proteins. In some embodiments, the RT fragment is at least 100 amino acids in length. In some embodiments, the fragment is at least 100, 150, 200, 250, 300, 350, 400, 450, 500, 550, or up to 600 or more amino acids in length.

In still other embodiments, the disclosure also may utilize RT variants which are truncated at the N-terminus or the C-terminus, or both, by a certain number of amino acids which results in a truncated variant which still retains sufficient polymerase function. In some embodiments, the RT truncated variant has a truncation of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, 40, 50, 60, 70, 80, 90, 100, 110, 120, 130, 140, 150, 160, 170, 180, 190, 200, 210, 220, 230, 240, or 250 amino acids at the N-terminal end of the protein. In other embodiments, the RT truncated variant has a truncation of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, 40, 50, 60, 70, 80, 90, 100, 110, 120, 130, 140, 150, 160, 170, 180, 190, 200, 210, 220, 230, 240, or 250 amino acids at the C-terminal end of the protein. In still other embodiments, the RT truncated variant has a trunction at the N-terminal and the C-terminal end which are the same or different lengths.

For example, the prime editors disclosed herein may include a truncated version of M-MLV reverse transcriptase. In this embodiment, the reverse transcriptase contains 4 mutations (D200N, T306K, W313F, T330P; noting that the L603W mutation present in PE2 is no longer present due to the truncation). The DNA sequence encoding this truncated editor is 522 bp smaller than PE2, and therefore makes its potentially useful for applications where delivery of the DNA sequence is challenging due to its size (i.e., adeno-associated virus and lentivirus delivery). This embodiment is referred to as MMLV-RT(trunc) and has the following amino acid sequence:

| | |
|---|---|
| MMLV-RT(TRUNC) | TLNIEDEYRLHETSKEPDVSLGSTWLSDFPQAWAETGGM GLAVRQAPLIIPLKATSTPVSIKQYPMSQEARLGIKPHI QRLLDQGILVPCQSPWNTPLLPVKKPGTNDYRPVQDLRE VNKRVEDIHPTVPNPYNLLSGLPPSHQWYTVLDLKDAFF CLRLHPTSQPLFAFEWRDPEMGISGQLTWTRLPQGFKNS PTLFNEALHRDLADFRIQHPDLILLQYVDDLLLAATSEL |

-continued

```
DCQQGTRALLQTLGNLGYRASAKKAQICQKQVKYLGYLL
KEGQRWLTEARKETVMGQPTPKTPRQLREFLGKAGFCRL
FIPGFAEMAAPLYPLTKPGTLFNWGPDQQKAYQEIKQAL
LTAPALGLPDLTKPFELFVDEKQGYAKGVLTQKLGPWRR
PVAYLSKKLDPVAAGWPPCLRMVAAIAVLTKDAGKLTMG
QPLVILAPHAVEALVKQPPDRWLSNARMTHYQALLLDTD
RVQFGPVVALNPATLLPLPEEGLQHNCLDNSRLIN (SEQ
ID NO: 766)
```

In various embodiments, the prime editors disclosed herein may comprise one of the RT variants described herein, or a RT variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 variants.

In still other embodiments, the present methods and compositions may utilize a DNA polymerase that has been evolved into a reverse transcriptase, as described in Effefson et al., "Synthetic evolutionary origin of a proofreading reverse transcriptase," *Science*, Jun. 24, 2016, Vol. 352: 1590-1593, the contents of which are incorporated herein by reference.

In certain other embodiments, the reverse transcriptase is provided as a component of a fusion protein also comprising a napDNAbp. In other words, in some embodiments, the reverse transcriptase is fused to a napDNAbp as a fusion protein.

In various embodiments, variant reverse transcriptases can be engineered from wild type M-MLV reverse transcriptase as represented by SEQ ID NO: 89.

In various embodiments, the prime editors described herein (with RT provided as either a fusion partner or in trans) can include a variant RT comprising one or more of the following mutations: P51L, S67K, E69K, L139P, T197A, D200N, H204R, F209N, E302K, E302R, T306K, F309N, W313F, T330P, L345G, L435G, N454K, D524G, E562Q, D583N, H594Q, L603W, E607K, or D653N in the wild type M-MLV RT of SEQ ID NO: 89 or at a corresponding amino acid position in another wild type RT polypeptide sequence.

Some exemplary reverse transcriptases that can be fused to napDNAbp proteins or provided as individual proteins according to various embodiments of this disclosure are provided below. Exemplary reverse transcriptases include variants with at least 80%, at least 85%, at least 90%, at least 95%, or at least 99% sequence identity to the following wild-type enzymes or partial enzymes:

| Description | Sequence (variant substitutions relative to wild type) |
|---|---|
| Reverse transcriptase (M-MLV RT) wild type moloney murine leukemia virus Used in PE1 (prime editor 1 fusion protein disclosed herein) | TLNIEDEYRLHETSKEPDVSLGSTWLSDFPQAWAETGGMGLAVRQAP LIIPLKATSTPVSIKQYPMSQEARLGIKPHIQRLLDQGILVPCQSPWNTPL LPVKKPGTNDYRPVQDLREVNKRVEDIHPTVPNPYNLLSGLPPSHQWY TVLDLKDAFFCLRLHPTSQPLFAFEWRDPEMGISGQLTWTRLPQGFKN SPTLFDEALHRDLADFRIQHPDLILLQYVDDLLLAATSELDCQQGTRAL LQTLGNLGYRASAKKAQICQKQVKYLGYLLKEGQRWLTEARKETVM GQPTPKTPRQLREFLGTAGFCRLWIPGFAEMAAPLYPLTKTGTLFNWG PDQQKAYQEIKQALLTAPALGLPDLTKPFELFVDEKQGYAKGVLTQKL GPWRRPVAYLSKKLDPVAAGWPPCLRMVAAIAVLTKDAGKLTMGQP LVILAPHAVEALVKQPPDRWLSNARMTHYQALLLDTDRVQFGPVVAL NPATLLPLPEEGLQHNCLDILAEAHGTRPDLTDQPLPDADHTWYTDGS SLLQEGQRKAGAAVTTETEVIWAKALPAGTSAQRAELIALTQALKMA EGKKLNVYTDSRYAFATAHIHGEIYRRRGLLTSEGKEIKNKDEILALLK ALFLPKRLSIIHCPGHQKGHSAEARGNRMADQAARKAAITETPDTSTLL IENSSP (SEQ ID NO: 700) |
| M-MLV RT D200N | TLNIEDEYRLHETSKEPDVSLGSTWLSDFPQAWAETGGMGLAVRQAP LIIPLKATSTPVSIKQYPMSQEARLGIKPHIQRLLDQGILVPCQSPWNTPL LPVKKPGTNDYRPVQDLREVNKRVEDIHPTVPNPYNLLSGLPPSHQWY TVLDLKDAFFCLRLHPTSQPLFAFEWRDPEMGISGQLTWTRLPQGFKN SPTLF<u>N</u>EALHRDLADFRIQHPDLILLQYVDDLLLAATSELDCQQGTRAL LQTLGNLGYRASAKKAQICQKQVKYLGYLLKEGQRWLTEARKETVM GQPTPKTPRQLREFLGTAGFCRLWIPGFAEMAAPLYPLTKTGTLFNWG PDQQKAYQEIKQALLTAPALGLPDLTKPFELFVDEKQGYAKGVLTQKL GPWRRPVAYLSKKLDPVAAGWPPCLRMVAAIAVLTKDAGKLTMGQP LVILAPHAVEALVKQPPDRWLSNARMTHYQALLLDTDRVQFGPVVAL NPATLLPLPEEGLQHNCLDILAEAHGTRPDLTDQPLPDADHTWYTDGS SLLQEGQRKAGAAVTTETEVIWAKALPAGTSAQRAELIALTQALKMA EGKKLNVYTDSRYAFATAHIHGEIYRRRGLLTSEGKEIKNKDEILALLK ALFLPKRLSIIHCPGHQKGHSAEARGNRMADQAARKAAITETPDTSTLL IENSSP (SEQ ID NO: 701) |
| M-MLV RT D200N T330P | TLNIEDEYRLHETSKEPDVSLGSTWLSDFPQAWAETGGMGLAVRQAP LIIPLKATSTPVSIKQYPMSQEARLGIKPHIQRLLDQGILVPCQSPWNTPL LPVKKPGTNDYRPVQDLREVNKRVEDIHPTVPNPYNLLSGLPPSHQWY TVLDLKDAFFCLRLHPTSQPLFAFEWRDPEMGISGQLTWTRLPQGFKN SPTLF<u>N</u>EALHRDLADFRIQHPDLILLQYVDDLLLAATSELDCQQGTRAL LQTLGNLGYRASAKKAQICQKQVKYLGYLLKEGQRWLTEARKETVM GQPTPKTPRQLREFLGTAGFCRLWIPGFAEMAAPLYPLTK<u>P</u>GTLFNWG PDQQKAYQEIKQALLTAPALGLPDLTKPFELFVDEKQGYAKGVLTQKL GPWRRPVAYLSKKLDPVAAGWPPCLRMVAAIAVLTKDAGKLTMGQP LVILAPHAVEALVKQPPDRWLSNARMTHYQALLLDTDRVQFGPVVAL NPATLLPLPEEGLQHNCLDILAEAHGTRPDLTDQPLPDADHTWYTDGS SLLQEGQRKAGAAVTTETEVIWAKALPAGTSAQRAELIALTQALKMA EGKKLNVYTDSRYAFATAHIHGEIYRRRGLLTSEGKEIKNKDEILALLK ALFLPKRLSIIHCPGHQKGHSAEARGNRMADQAARKAAITETPDTSTLL IENSSP (SEQ ID NO: 702) |

| Description | Sequence (variant substitutions relative to wild type) |
|---|---|
| M-MLV RT<br>D200N<br>T330P<br>L603W | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 740) |
| M-MLV RT<br>D200N<br>T330P<br>L603W<br>E69K | TLNIEDEYRLHETSKEPDVSLGSTWLSDFPQAWAETGGMGLAVRQAP<br>LIIPLKATSTPVSIKQYPMSQKARLGIKPHIQRLLDQGILVPCQSPWNTP<br>LLPVKKPGTNDYRPVQDLREVNKRVEDIHPTVPNPYNLLSGLPPSHQW<br>YTVLDLKDAFFCLRLHPTSQPLFAFEWRDPEMGISGQLTWTRLPQGFK<br>NSPTLFNEALHRDLADFRIQHPDLILLQYVDDLLLAATSELDCQQGTRA<br>LLQTLGNLGYRASAKKAQICQKQVKYLGYLLKEGQRWLTEARKETV<br>MGQPTPKTPRQLREFLGTAGFCRLWIPGFAEMAAPLYPLTKPGTLFNW<br>GPDQQKAYQEIKQALLTAPALGLPDLTKPFELFVDEKQGYAKGVLTQ<br>KLGPWRRPVAYLSKKLDPVAAGWPPCLRMVAAIAVLTKDAGKLTMG<br>QPLVILAPHAVEALVKQPPDRWLSNARMTHYQALLLDTDRVQFGPVV<br>ALNPATLLPLPEEGLQHNCLDILAEAHGTRPDLTDQPLPDADHTWYTD<br>GSSLLQEGQRKAGAAVTTETEVIWAKALPAGTSAQRAELIALTQALK<br>MAEGKKLNVYTDSRYAFATAHIHGEIYRRRGWLTSEGKEIKNKDEILA<br>LLKALFLPKRLSIIHCPGHQKGHSAEARGNRMADQAARKAAITETPDT<br>STLLIENSSP (SEQ ID NO: 703) |
| M-MLV RT<br>D200N<br>T330P<br>L603W<br>E302R | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLRRFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP(SEQ ID NO: 704) |
| M-MLV RT<br>D200N<br>T330P<br>L603W<br>E607K | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSKGKEIKNKDEILALL<br>KALFLPKRLSIIHCPGHQKGHSAEARGNRMADQAARKAAITETPDTST<br>LLIENSSP (SEQ ID NO: 705) |
| M-MLV RT<br>D200N<br>T330P<br>L603W<br>L139P | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGPPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA |

| Description | Sequence (variant substitutions relative to wild type) |
|---|---|
| | EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 706) |
| M-MLV RT<br>D200N<br>T330P<br>L603W<br>L435G | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVIGAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 707) |
| M-MLV RT<br>D200N<br>T330P<br>L603W<br>N454K | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSKARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 708) |
| M-MLV RT<br>D200N<br>T330P<br>L603W<br>T306K | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGKAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 709) |
| M-MLV RT<br>D200N<br>T330P<br>L603W<br>W313F | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLFIPGFAEMAAPLYPLTKPGTLFNWGP<br>DQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 710) |
| M-MLV RT<br>D200N<br>T330P<br>L603W<br>D524G<br>E562Q<br>D583N | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP |

| Description | Sequence (variant substitutions relative to wild type) |
|---|---|
| | LVILAPHAVEALVKQPPDRWLSNARMTHYQALLLDTDRVQFGPVVAL<br>NPATLLPLPEEGLQHNCLDILAEAHGTRPDLTDQPLPDADHTWYTGGS<br>SLLQEGQRKAGAAVTTETEVIWAKALPAGTSAQRAQLIALTQALKMA<br>EGKKLNVYTNSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 711) |
| M-MLV RT<br>D200N<br>T330P<br>L603W<br>E302R<br>W313F | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLRRFLGTAGFCRLFIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSEGKEIKNKDEILALL<br>KALFLPKRLSIIHCPGHQKGHSAEARGNRMADQAARKAAITETPDTST<br>LLIENSSP (SEQ ID NO: 712) |
| M-MLV RT<br>D200N<br>T330P<br>L603W<br>E607K<br>L139P | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGPPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLREFLGTAGFCRLWIPGFAEMAAPLYPLTKPGTLFNWG<br>PDQQKAYQEIKQALLTAPALGLPDLTKPFELFVDEKQGYAKGVLTQKL<br>GPWRRPVAYLSKKLDPVAAGWPPCLRMVAAIAVLTKDAGKLTMGQP<br>LVILAPHAVEALVKQPPDRWLSNARMTHYQALLLDTDRVQFGPVVAL<br>NPATLLPLPEEGLQHNCLDILAEAHGTRPDLTDQPLPDADHTWYTDGS<br>SLLQEGQRKAGAAVTTETEVIWAKALPAGTSAQRAELIALTQALKMA<br>EGKKLNVYTDSRYAFATAHIHGEIYRRRGWLTSKGKEIKNKDEILALL<br>KALFLPKRLSIIHCPGHQKGHSAEARGNRMADQAARKAAITETPDTST<br>LLIENSSP (SEQ ID NO: 713) |
| M-MLV RT<br>P51L S67K<br>T197A<br>H204R<br>E302K<br>F309N<br>W313F<br>T330P<br>L435G<br>N454K<br>D524G<br>D583N<br>H594Q<br>D653N | TLNIEDEYRLHETSKEPDVSLGSTWLSDFPQAWAETGGMGLAVRQAP<br>LIILLKATSTPVSIKQYPMKQEARLGIKPHIQRLLDQGILVPCQSPWNTP<br>LLPVKKPGTNDYRPVQDLREVNKRVEDIHPTVPNPYNLLSGLPPSHQW<br>YTVLDLKDAFFCLRLHPTSQPLFAFEWRDPEMGISGQLTWTRLPQGFK<br>NSPALFDEALRRDLADFRIQHPDLILLQYVDDLLLAATSELDCQQGTR<br>ALLQTLGNLGYRASAKKAQICQKQVKYLGYLLKEGQRWLTEARKET<br>VMGQPTPKTPRQLRKFLGTAGNCRLFIPGFAEMAAPLYPLTKPGTLFN<br>WGPDQQKAYQEIKQALLTAPALGLPDLTKPFELFVDEKQGYAKGVLT<br>QKLGPWRRPVAYLSKKLDPVAAGWPPCLRMVAAIAVLTKDAGKLTM<br>GQPLVIGAPHAVEALVKQPPDRWLSKARMTHYQALLLDTDRVQFGPV<br>VALNPATLLPLPEEGLQHNCLDILAEAHGTRPDLTDQPLPDADHTWYT<br>GGSSLLQEGQRKAGAAVTTETEVIWAKALPAGTSAQRAELIALTQALK<br>MAEGKKLNVYTNSRYAFATAHIQGEIYRRRGLLTSEGKEIKNKDEILA<br>LLKALFLPKRLSIIHCPGHQKGHSAEARGNRMANQAARKAAITETPDT<br>STLLIENSSP (SEQ ID NO: 714) |
| M-MLV RT<br>D200N P51L<br>S67K T197A<br>H204R<br>E302K<br>F309N<br>W313F<br>T330P L345G<br>N454K<br>D524G<br>D583N<br>H594Q<br>D653N | TLNIEDEYRLHETSKEPDVSLGSTWLSDFPQAWAETGGMGLAVRQAP<br>LIILLKATSTPVSIKQYPMKQEARLGIKPHIQRLLDQGILVPCQSPWNTP<br>LLPVKKPGTNDYRPVQDLREVNKRVEDIHPTVPNPYNLLSGLPPSHQW<br>YTVLDLKDAFFCLRLHPTSQPLFAFEWRDPEMGISGQLTWTRLPQGFK<br>NSPALFNEALRRDLADFRIQHPDLILLQYVDDLLLAATSELDCQQGTR<br>ALLQTLGNLGYRASAKKAQICQKQVKYLGYLLKEGQRWLTEARKET<br>VMGQPTPKTPRQLRKFLGTAGNCRLFIPGFAEMAAPLYPLTKPGTLFN<br>WGPDQQKAYQEIKQALLTAPALGLPDLTKPFELFVDEKQGYAKGVLT<br>QKLGPWRRPVAYLSKKLDPVAAGWPPCLRMVAAIAVLTKDAGKLTM<br>GQPLVIGAPHAVEALVKQPPDRWLSKARMTHYQALLLDTDRVQFGPV<br>VALNPATLLPLPEEGLQHNCLDILAEAHGTRPDLTDQPLPDADHTWYT<br>GGSSLLQEGQRKAGAAVTTETEVIWAKALPAGTSAQRAELIALTQALK<br>MAEGKKLNVYTNSRYAFATAHIQGEIYRRRGLLTSEGKEIKNKDEILA<br>LLKALFLPKRLSIIHCPGHQKGHSAEARGNRMANQAARKAAITETPDT<br>STLLIENSSP (SEQ ID NO: 715) |
| M-MLV RT<br>D200N<br>T330P<br>L603W<br>T306K | TLNIEDEYRLHETSKEPDVSLGSTWLSDFPQAWAETGGMGLAVRQAP<br>LIIPLKATSTPVSIKQYPMSQEARLGIKPHIQRLLDQGILVPCQSPWNTPL<br>LPVKKPGTNDYRPVQDLREVNKRVEDIHPTVPNPYNLLSGLPPSHQWY<br>TVLDLKDAFFCLRLHPTSQPLFAFEWRDPEMGISGQLTWTRLPQGFKN<br>SPTLFNEALHRDLADFRIQHPDLILLQYVDDLLLAATSELDCQQGTRAL |

| Description | Sequence (variant substitutions relative to wild type) |
|---|---|
| W313F in PE2 | LQTLGNLGYRASAKKAQICQKQVKYLGYLLKEGQRWLTEARKETVM GQPTPKTPRQLREFLG<u>K</u>AGFCRL<u>F</u>IPGFAEMAAPLYPLTK<u>P</u>GTLFNWG PDQQKAYQEIKQALLTAPALGLPDLTKPFELFVDEKQGYAKGVLTQKL GPWRRPVAYLSKKLDPVAAGWPPCLRMVAAIAVLTKDAGKLTMGQP LVILAPHAVEALVKQPPDRWLSNARMTHYQALLLDTDRVQFGPVVAL NPATLLPLPEEGLQHNCLDILAEAHGTRPDLTDQPLPDADHTWYTDGS SLLQEGQRKAGAAVTTETEVIWAKALPAGTSAQRAELIALTQALKMA EGKKLNVYTDSRYAFATAHIHGEIYRRRG<u>W</u>LTSEGKEIKNKDEILALL KALFLPKRLSIIHCPGHQKGHSAEARGNRMADQAARKAAITETPDTST LLIENSSP (SEQ ID NO: 716) |

In various other embodiments, the prime editors described herein (with RT provided as either a fusion partner or in trans) can include a variant RT comprising one or more of the following mutations: P51X, S67X, E69X, L139X, T197X, D200X, H204X, F209X, E302X, T306X, F309X, W313X, T330X, L345X, L435X, N454X, D524X, E562X, D583X, H594X, L603X, E607X, or D653X in the wild type M-MLV RT of SEQ ID NO: 89 or at a corresponding amino acid position in another wild type RT polypeptide sequence, wherein "X" can be any amino acid.

In various other embodiments, the prime editors described herein (with RT provided as either a fusion partner or in trans) can include a variant RT comprising a P51X mutation in the wild type M-MLV RT of SEQ ID NO: 89 or at a corresponding amino acid position in another wild type RT polypeptide sequence, wherein "X" can be any amino acid. In certain embodiments, X is L.

In various other embodiments, the prime editors described herein (with RT provided as either a fusion partner or in trans) can include a variant RT comprising a S67X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a E69X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a L139X mutation in the wild type M-MLV RT of SEQ ID NO: 89 or at a corresponding amino acid position in another wild type RT polypeptide sequence, wherein "X" can be any amino acid. In certain embodiments, X is P.

In various other embodiments, the prime editors described herein (with RT provided as either a fusion partner or in trans) can include a variant RT comprising a T197X mutation in the wild type M-MLV RT of SEQ ID NO: 89 or at a corresponding amino acid position in another wild type RT polypeptide sequence, wherein "X" can be any amino acid. In certain embodiments, X is A.

In various other embodiments, the prime editors described herein (with RT provided as either a fusion partner or in trans) can include a variant RT comprising a D200X mutation in the wild type M-MLV RT of SEQ ID NO: 89 or at a corresponding amino acid position in another wild type RT polypeptide sequence, wherein "X" can be any amino acid. In certain embodiments, X is N.

In various other embodiments, the prime editors described herein (with RT provided as either a fusion partner or in trans) can include a variant RT comprising a H204X mutation in the wild type M-MLV RT of SEQ ID NO: 89 or at a corresponding amino acid position in another wild type RT polypeptide sequence, wherein "X" can be any amino acid. In certain embodiments, X is R.

In various other embodiments, the prime editors described herein (with RT provided as either a fusion partner or in trans) can include a variant RT comprising a F209X mutation in the wild type M-MLV RT of SEQ ID NO: 89 or at a corresponding amino acid position in another wild type RT polypeptide sequence, wherein "X" can be any amino acid. In certain embodiments, X is N.

In various other embodiments, the prime editors described herein (with RT provided as either a fusion partner or in trans) can include a variant RT comprising a E302X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a E302X mutation in the wild type M-MLV RT of SEQ ID NO: 89 or at a corresponding amino acid position in another wild type RT polypeptide sequence, wherein "X" can be any amino acid. In certain embodiments, X is R.

In various other embodiments, the prime editors described herein (with RT provided as either a fusion partner or in trans) can include a variant RT comprising a T306X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a F309X mutation in the wild type M-MLV RT of SEQ ID NO: 89 or at a corresponding amino acid position in another wild type RT polypeptide sequence, wherein "X" can be any amino acid. In certain embodiments, X is N.

In various other embodiments, the prime editors described herein (with RT provided as either a fusion partner or in trans) can include a variant RT comprising a W313X mutation in the wild type M-MLV RT of SEQ ID NO: 89 or at a corresponding amino acid position in another wild type RT polypeptide sequence, wherein "X" can be any amino acid. In certain embodiments, X is F.

In various other embodiments, the prime editors described herein (with RT provided as either a fusion partner or in trans) can include a variant RT comprising a T330X mutation in the wild type M-MLV RT of SEQ ID NO: 89 or at a corresponding amino acid position in another wild type RT polypeptide sequence, wherein "X" can be any amino acid. In certain embodiments, X is P.

In various other embodiments, the prime editors described herein (with RT provided as either a fusion partner or in trans) can include a variant RT comprising a L345X mutation in the wild type M-MLV RT of SEQ ID NO: 89 or at a corresponding amino acid position in another wild type RT polypeptide sequence, wherein "X" can be any amino acid. In certain embodiments, X is G.

In various other embodiments, the prime editors described herein (with RT provided as either a fusion partner or in trans) can include a variant RT comprising a L435X mutation in the wild type M-MLV RT of SEQ ID NO: 89 or at a corresponding amino acid position in another wild type RT polypeptide sequence, wherein "X" can be any amino acid. In certain embodiments, X is G.

In various other embodiments, the prime editors described herein (with RT provided as either a fusion partner or in trans) can include a variant RT comprising a N454X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a D524X mutation in the wild type M-MLV RT of SEQ ID NO: 89 or at a corresponding amino acid position in another wild type RT polypeptide sequence, wherein "X" can be any amino acid. In certain embodiments, X is G.

In various other embodiments, the prime editors described herein (with RT provided as either a fusion partner or in trans) can include a variant RT comprising a E562X mutation in the wild type M-MLV RT of SEQ ID NO: 89 or at a corresponding amino acid position in another wild type RT polypeptide sequence, wherein "X" can be any amino acid. In certain embodiments, X is Q.

In various other embodiments, the prime editors described herein (with RT provided as either a fusion partner or in trans) can include a variant RT comprising a D583X mutation in the wild type M-MLV RT of SEQ ID NO: 89 or at a corresponding amino acid position in another wild type RT polypeptide sequence, wherein "X" can be any amino acid. In certain embodiments, X is N.

In various other embodiments, the prime editors described herein (with RT provided as either a fusion partner or in trans) can include a variant RT comprising a H594X mutation in the wild type M-MLV RT of SEQ ID NO: 89 or at a corresponding amino acid position in another wild type RT polypeptide sequence, wherein "X" can be any amino acid. In certain embodiments, X is Q.

In various other embodiments, the prime editors described herein (with RT provided as either a fusion partner or in trans) can include a variant RT comprising a L603X mutation in the wild type M-MLV RT of SEQ ID NO: 89 or at a corresponding amino acid position in another wild type RT polypeptide sequence, wherein "X" can be any amino acid. In certain embodiments, X is W.

In various other embodiments, the prime editors described herein (with RT provided as either a fusion partner or in trans) can include a variant RT comprising a E607X mutation in the wild type M-MLV RT of SEQ ID NO: 89 or at a corresponding amino acid position in another wild type RT polypeptide sequence, wherein "X" can be any amino acid. In certain embodiments, X is K.

In various other embodiments, the prime editors described herein (with RT provided as either a fusion partner or in trans) can include a variant RT comprising a D653X mutation in the wild type M-MLV RT of SEQ ID NO: 89 or at a corresponding amino acid position in another wild type RT polypeptide sequence, wherein "X" can be any amino acid. In certain embodiments, X is N.

Some exemplary reverse transcriptases that can be fused to napDNAbp proteins or provided as individual proteins according to various embodiments of this disclosure are provided below. Exemplary reverse transcriptases include variants with at least 80%, at least 85%, at least 90%, at least 95% or at least 99% sequence identity to the following wild-type enzymes or partial enzymes:

| DESCRIPTION | SEQUENCE (VARIANT SUBSTITUTIONS RELATIVE TO WILD TYPE) |
|---|---|
| REVERSE TRANSCRIPTASE M-MLV RT) WILD TYPE MOLONEY MURINE LEUKEMIA VIRUS USED IN PE1 (PRIME EDITOR 1 FUSION PROTEIN DISCLOSED HEREIN) | TLNIEDEYRLHETSKEPDVSLGSTWLSDFPQAWAETGGMGLAVRQAPL IIPLKATSTPVSIKQYPMSQEARLGIKPHIQRLLDQGILVPCQSPWNTPLL PVKKPGTNDYRPVQDLREVNKRVEDIHPTVPNPYNLLSGLPPSHQWYT VLDLKDAFFCLRLHPTSQPLFAFEWRDPEMGISGQLTWTRLPQGFKNSP TLFDEALHRDLADFRIQHPDLILLQYVDDLLLAATSELDCQQGTRALLQ TLGNLGYRASAKKAQICQKQVKYLGYLLKEGQRWLTEARKETVMGQ PTPKTPRQLREFLGTAGFCRLWIPGFAEMAAPLYPLTKTGTLFNWGPDQ QKAYQEIKQALLTAPALGLPDLTKPFELFVDEKQGYAKGVLTQKLGPW RRPVAYLSKKLDPVAAGWPPCLRMVAAIAVLTKDAGKLTMGQPLVILA PHAVEALVKQPPDRWLSNARMTHYQALLLDTDRVQFGPVVALNPATLL PLPEEGLQHNCLDILAEAHGTRPDLTDQPLPDADHTWYTDGSSLLQEG QRKAGAAVTTETEVIWAKALPAGTSAQRAELIALTQALKMAEGKKLN VYTDSRYAFATAHIHGEIYRRRGLLTSEGKEIKNKDEILALLKALFLPKR LSIIHCPGHQKGHSAEARGNRMADQAARKAAITETPDTSTLLIENSSP (SEQ ID NO: 89) |
| M-MLV RT D200N | TLNIEDEYRLHETSKEPDVSLGSTWLSDFPQAWAETGGMGLAVRQAPL IIPLKATSTPVSIKQYPMSQEARLGIKPHIQRLLDQGILVPCQSPWNTPLL PVKKPGTNDYRPVQDLREVNKRVEDIHPTVPNPYNLLSGLPPSHQWYT VLDLKDAFFCLRLHPTSQPLFAFEWRDPEMGISGQLTWTRLPQGFKNSP TLFNEALHRDLADFRIQHPDLILLQYVDDLLLAATSELDCQQGTRALLQ TLGNLGYRASAKKAQICQKQVKYLGYLLKEGQRWLTEARKETVMGQ PTPKTPRQLREFLGTAGFCRLWIPGFAEMAAPLYPLTKTGTLFNWGPDQ QKAYQEIKQALLTAPALGLPDLTKPFELFVDEKQGYAKGVLTQKLGPW RRPVAYLSKKLDPVAAGWPPCLRMVAAIAVLTKDAGKLTMGQPLVILA PHAVEALVKQPPDRWLSNARMTHYQALLLDTDRVQFGPVVALNPATLL PLPEEGLQHNCLDILAEAHGTRPDLTDQPLPDADHTWYTDGSSLLQEG |

| DESCRIPTION | SEQUENCE (VARIANT SUBSTITUTIONS RELATIVE TO WILD TYPE) |
|---|---|
| | QRKAGAAVTTETEVIWAKALPAGTSAQRAELIALTQALKMAEGKKLN<br>VYTDSRYAFATAHIHGEIYRRRGLLTSEGKEIKNKDEILALLKALFLPKR<br>LSIIHCPGHQKGHSAEARGNRMADQAARKAAITETPDTSTLLIENSSP<br>(SEQ ID NO: 106) |
| M-MLV RT<br>D200N<br>T330P | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGLLTSEGKEIKNKDEILALLKALFLPKR<br>LSIIHCPGHQKGHSAEARGNRMADQAARKAAITETPDTSTLLIENSSP<br>(SEQ ID NO: 107) |
| M-MLV RT<br>D200N<br>T330P<br>L603W | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 108) |
| M-MLV RT<br>E69K<br>D200N<br>T330P<br>L603W | TLNIEDEYRLHETSKEPDVSLGSTWLSDFPQAWAETGGMGLAVRQAPL<br>IIPLKATSTPVSIKQYPMSQKARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 109) |
| M-MLV RT<br>D200N<br>T330P<br>L603W<br>E302R | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLRRFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 110) |
| M-MLV RT<br>D200N<br>T330P<br>L603W<br>E607K | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW |

| DESCRIPTION | SEQUENCE (VARIANT SUBSTITUTIONS RELATIVE TO WILD TYPE) |
|---|---|
| | RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSKGKEIKNKDEILALLKALFLPK<br>RLSIIHCPGHQKGHSAEARGNRMADQAARKAAITETPDTSTLLIENSSP<br>(SEQ ID NO: 111) |
| M-MLV RT<br>D200N<br>T330P<br>L603W<br>L139P | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGPPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 112) |
| M-MLV RT<br>D200N<br>T330P<br>L603W<br>L435G | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVIGA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 113) |
| M-MLV RT<br>D200N<br>T330P<br>L603W<br>N454K | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSKARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 114) |
| M-MLV RT<br>D200N<br>T330P<br>L603W<br>T306K | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLKAGFCRLWIPGFAEMAAPLYPLTKPGTLFNWGPD<br>QQKAYQEIKQALLTAPALGLPDLTKPFELFVDEKQGYAKGVLTQKLGP<br>WRRPVAYLSKKLDPVAAGWPPCLRMVAAIAVLTKDAGKLTMGQPLVIL<br>APHAVEALVKQPPDRWLSNARMTHYQALLLDTDRVQFGPVVALNPAT<br>LLPLPEEGLQHNCLDILAEAHGTRPDLTDQPLPDADHTWYTDGSSLLQ<br>EGQRKAGAAVTTETEVIWAKALPAGTSAQRAELIALTQALKMAEGKKL<br>NVYTDSRYAFATAHIHGEIYRRRGWLTSEGKEIKNKDEILALLKALFLP<br>KRLSIIHCPGHQKGHSAEARGNRMADQAARKAAITETPDTSTLLIENSSP<br>(SEQ ID NO: 115) |
| M-MLV RT<br>D200N<br>T330P | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT |

-continued

| DESCRIPTION | SEQUENCE (VARIANT SUBSTITUTIONS RELATIVE TO WILD TYPE) |
|---|---|
| L603W<br>W313F | VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLFIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 116) |
| M-MLV RT<br>D200N<br>T330P<br>L603W<br>D524G<br>E562Q<br>D583N | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLFIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTGGSSLLQEG<br>QRKAGAAVTTETEVIWAKALPAGTSAQRAQLIALTQALKMAEGKKLN<br>VYTNSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 117) |
| M-MLV RT<br>D200N<br>T330P<br>L603W<br>E302R<br>W313F | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLRRFLGTAGFCRLFIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTGGSSLLQEG<br>QRKAGAAVTTETEVIWAKALPAGTSAQRAQLIALTQALKMAEGKKLN<br>VYTDSRYAFATAHIHGEIYRRRGWLTSEGKEIKNKDEILALLKALFLPKR<br>LSIIHCPGHQKGHSAEARGNRMADQAARKAAITETPDTSTLLIENSSP<br>(SEQ ID NO: 118) |
| M-MLV RT<br>D200N<br>T330P<br>L603W<br>E607K<br>L139P | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGPPPSHQWYT<br>VLDLKDAFFCLRLHPTSQPLFAFEWRDPEMGISGQLTWTRLPQGFKNSP<br>TLFNEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLRRFLGTAGFCRLWIPGFAEMAAPLYPLTKPGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGWLTSKGKEIKNKDEILALLKALFLPK<br>RLSIIHCPGHQKGHSAEARGNRMADQAARKAAITETPDTSTLLIENSSP<br>(SEQ ID NO: 119) |
| M-MLV RT<br>P51L S67K<br>T197A<br>H204R<br>E302K<br>F309N<br>W313F<br>T330P<br>L435G<br>N454K<br>D524G<br>D583N<br>H594Q<br>D653N | TLNIEDEYRLHETSKEPDVSLGSTWLSDFPQAWAETGGMGLAVRQAPL<br>IILLKATSTPVSIKQYPMKQEARLGIKPHIQRLLDQGILVPCQSPWNTPL<br>LPVKKPGTNDYRPVQDLREVNKRVEDIHPTVPNPYNLLSGPPPSHQWY<br>TVLDLKDAFFCLRLHPTSQPLFAFEWRDPEMGISGQLTWTRLPQGFKN<br>SPALFDEALRRDLADFRIQHPDLILLQYVDDLLLAATSELDCQQGTRAL<br>LQTLGNLGYRASAKKAQICQKQVKYLGYLLKEGQRWLTEARKETVM<br>GQPTPKTPRQLRKFLGTAGNCRLFIPGFAEMAAPLYPLTKPGTLFNWGP<br>DQQKAYQEIKQALLTAPALGLPDLTKPFELFVDEKQGYAKGVLTQKLG<br>PWRRPVAYLSKKLDPVAAGWPPCLRMVAAIAVLTKDAGKLTMGQPLVI<br>GAPHAVEALVKQPPDRWLSKARMTHYQALLLDTDRVQFGPVVALNPA<br>TLLPLPEEGLQHNCLDILAEAHGTRPDLTDQPLPDADHTWYTGGSSLL<br>QEGQRKAGAAVTTETEVIWAKALPAGTSAQRAELIALTQALKMAEGK<br>KLNVYTNSRYAFATAHIQGEIYRRRGLLTSEGKEIKNKDEILALLKALFL<br>PKRLSIIHCPGHQKGHSAEARGNRMANQAARKAAITETPDTSTLLIENS<br>SP(SEQ ID NO: 120) |

| DESCRIPTION | SEQUENCE (VARIANT SUBSTITUTIONS RELATIVE TO WILD TYPE) |
|---|---|
| M-MLV RT | TLNIEDEYRLHETSKEPDVSLGSTWLSDFPQAWAETGGMGLAVRQAPL |
| P51L S67K | IILLKATSTPVSIKQYPMKQEARLGIKPHIQRLLDQGILVPCQSPWNTPL |
| T197A | LPVKKPGTNDYRPVQDLREVNKRVEDIHPTVPNPYNLLSGLPPSHQWY |
| D200N | TVLDLKDAFFCLRLHPTSQPLFAFEWRDPEMGISGQLTWTRLPQGFKN |
| H204R | SPALFNEALRRDLADFRIQHPDLILLQYVDDLLLAATSELDCQQGTRAL |
| E302K | LQTLGNLGYRASAKKAQICQKQVKYLGYLLKEGQRWLTEARKETVM |
| F309N | GQPTPKTPRQLRKFLGTAGNCRLFIPGFAEMAAPLYPLTKPGTLFNWGP |
| W313F | DQQKAYQEIKQALLTAPALGLPDLTKPFELFVDEKQGYAKGVLTQKLG |
| T330P | PWRRPVAYLSKKLDPVAAGWPPCLRMVAAIAVLTKDAGKLTMGQPLVI |
| L345G | GAPHAVEALVKQPPDRWLSKARMTHYQALLLDTDRVQFGPVVALNPA |
| N454K | TLLPLPEEGLQHNCLDILAEAHGTRPDLTDQPLPDADHTWYTGGSSLL |
| D524G | QEGQRKAGAAVTTETEVIWAKALPAGTSAQRAELIALTQALKMAEGK |
| D583N | KLNVYTNSRYAFATAHIQGEIYRRRGLLTSEGKEIKNKDEILALLKALFL |
| H594Q | PKRLSIIHCPGHQKGHSAEARGNRMANQAARKAAITETPDTSTLLIENS |
| D653N | SP (SEQ ID NO: 121) |
| | |
| M-MLV RT | TLNIEDEYRLHETSKEPDVSLGSTWLSDFPQAWAETGGMGLAVRQAPL |
| D200N | IIPLKATSTPVSIKQYPMSQEARLGIKPHIQRLLDQGILVPCQSPWNTPLL |
| T330P | PVKKPGTNDYRPVQDLREVNKRVEDIHPTVPNPYNLLSGLPPSHQWYT |
| L603W | VLDLKDAFFCLRLHPTSQPLFAFEWRDPEMGISGQLTWTRLPQGFKNSP |
| T306K | TLFNEALHRDLADFRIQHPDLILLQYVDDLLLAATSELDCQQGTRALLQ |
| W313F | TLGNLGYRASAKKAQICQKQVKYLGYLLKEGQRWLTEARKETVMGQ |
| IN PE2 | PTPKTPRQLREFLGKAGFCRLFIPGFAEMAAPLYPLTKPGTLFNWGPDQ |
| | QKAYQEIKQALLTAPALGLPDLTKPFELFVDEKQGYAKGVLTQKLGPW |
| | RRPVAYLSKKLDPVAAGWPPCLRMVAAIAVLTKDAGKLTMGQPLVILA |
| | PHAVEALVKQPPDRWLSNARMTHYQALLLDTDRVQFGPVVALNPATLL |
| | PLPEEGLQHNCLDILAEAHGTRPDLTDQPLPDADHTWYTDGSSLLQEG |
| | QRKAGAAVTTETEVIWAKALPAGTSAQRAELIALTQALKMAEGKKLN |
| | VYTDSRYAFATAHIHGEIYRRRGWLTSEGKEIKNKDEILALLKALFLPKR |
| | LSIIHCPGHQKGHSAEARGNRMADQAARKAAITETPDTSTLLIENSSP |
| | (SEQ ID NO: 122) |

The prime editor (PE) system described here contemplates any publicly-available reverse transcriptase described or disclosed in any of the following U.S. patents (each of which are incorporated by reference in their entireties): U.S. Pat. Nos. 10,202,658; 10,189,831; 10,150,955; 9,932,567; 9,783,791; 9,580,698; 9,534,201; and 9,458,484, and any variant thereof that can be made using known methods for installing mutations, or known methods for evolving proteins. The following references describe reverse transcriptases in art. Each of their disclosures are incorporated herein by reference in their entireties.

Herzig, E., Voronin, N., Kucherenko, N. & Hizi, A. A Novel Leu92 Mutant of HIV-1 Reverse Transcriptase with a Selective Deficiency in Strand Transfer Causes a Loss of Viral Replication. *J. Virol.* 89, 8119-8129 (2015).

Mohr, G. et al. A Reverse Transcriptase-Cas1 Fusion Protein Contains a Cas6 Domain Required for Both CRISPR RNA Biogenesis and RNA Spacer Acquisition. *Mol. Cell* 72, 700-714.e8 (2018).

Zhao, C., Liu, F. & Pyle, A. M. An ultraprocessive, accurate reverse transcriptase encoded by a metazoan group II intron. *RNA* 24, 183-195 (2018).

Zimmerly, S. & Wu, L. An Unexplored Diversity of Reverse Transcriptases in Bacteria. *Microbiol Spectr* 3, MDNA3-0058-2014 (2015).

Ostertag, E. M. & Kazazian Jr, H. H. Biology of Mammalian L1 Retrotransposons. *Annual Review of Genetics* 35, 501-538 (2001).

Perach, M. & Hizi, A. Catalytic Features of the Recombinant Reverse Transcriptase of Bovine Leukemia Virus Expressed in Bacteria. *Virology* 259, 176-189 (1999).

Lim, D. et al. Crystal structure of the moloney murine leukemia virus RNase H domain. *J. Virol.* 80, 8379-8389 (2006).

Zhao, C. & Pyle, A. M. Crystal structures of a group II intron maturase reveal a missing link in spliceosome evolution. *Nature Structural & Molecular Biology* 23, 558-565 (2016).

Griffiths, D. J. Endogenous retroviruses in the human genome sequence. *Genome Biol.* 2, REVIEWS1017 (2001).

Baranauskas, A. et al. Generation and characterization of new highly thermostable and processive M-MuLV reverse transcriptase variants. *Protein Eng Des Sel* 25, 657-668 (2012).

Zimmerly, S., Guo, H., Perlman, P. S. & Lambowltz, A. M. Group II intron mobility occurs by target DNA-primed reverse transcription. *Cell* 82, 545-554 (1995).

Feng, Q., Moran, J. V., Kazazian, H. H. & Boeke, J. D. Human L1 retrotransposon encodes a conserved endonuclease required for retrotransposition. *Cell* 87, 905-916 (1996).

Berkhout, B., Jebbink, M. & Zsíros, J. Identification of an Active Reverse Transcriptase Enzyme Encoded by a Human Endogenous HERV-K Retrovirus. *Journal of Virology* 73, 2365-2375 (1999).

Kotewicz, M. L., Sampson, C. M., D'Alessio, J. M. & Gerard, G. F. Isolation of cloned Moloney murine leukemia virus reverse transcriptase lacking ribonuclease H activity. *Nucleic Acids Res* 16, 265-277 (1988).

Arezi, B. & Hogrefe, H. Novel mutations in Moloney Murine Leukemia Virus reverse transcriptase increase thermostability through tighter binding to template-primer. *Nucleic Acids Res* 37, 473-481 (2009).

Blain, S. W. & Goff, S. P. Nuclease activities of Moloney murine leukemia virus reverse transcriptase. Mutants with altered substrate specificities. *J. Biol. Chem.* 268, 23585-23592 (1993).

Xiong, Y. & Eickbush, T. H. Origin and evolution of retroelements based upon their reverse transcriptase sequences. *EMBO J* 9, 3353-3362 (1990).

Herschhorn, A. & Hizi, A. Retroviral reverse transcriptases. *Cell. Mol. Life Sci.* 67, 2717-2747 (2010).

Taube, R., Loya, S., Avidan, O., Perach, M. & Hizi, A. Reverse transcriptase of mouse mammary tumour virus: expression in bacteria, purification and biochemical characterization. *Biochem. J.* 329 (Pt 3), 579-587 (1998).

Liu, M. et al. Reverse Transcriptase-Mediated Tropism Switching in *Bordetella* Bacteriophage. *Science* 295, 2091-2094 (2002).

Luan, D. D., Korman, M. H., Jakubczak, J. L. & Eickbush, T. H. Reverse transcription of R2Bm RNA is primed by a nick at the chromosomal target site: a mechanism for non-LTR retrotransposition. *Cell* 72, 595-605 (1993).

Nottingham, R. M. et al. RNA-seq of human reference RNA samples using a thermostable group II intron reverse transcriptase. *RNA* 22, 597-613 (2016).

Telesnitsky, A. & Goff, S. P. RNase H domain mutations affect the interaction between Moloney murine leukemia virus reverse transcriptase and its primer-template. *Proc. Natl. Acad. Sci. U.S.A.* 90, 1276-1280 (1993).

Halvas, E. K., Svarovskaia, E. S. & Pathak, V. K. Role of Murine Leukemia Virus Reverse Transcriptase Deoxyribonucleoside Triphosphate-Binding Site in Retroviral Replication and In Vivo Fidelity. *Journal of Virology* 74, 10349-10358 (2000).

Nowak, E. et al. Structural analysis of monomeric retroviral reverse transcriptase in complex with an RNA/DNA hybrid. *Nucleic Acids Res* 41, 3874-3887 (2013).

Stamos, J. L., Lentzsch, A. M. & Lambowitz, A. M. Structure of a Thermostable Group II Intron Reverse Transcriptase with Template-Primer and Its Functional and Evolutionary Implications. *Molecular Cell* 68, 926-939.e4 (2017).

Das, D. & Georgiadis, M. M. The Crystal Structure of the Monomeric Reverse Transcriptase from Moloney Murine Leukemia Virus. *Structure* 12, 819-829 (2004).

Avidan, O., Meer, M. E., Oz, I. & Hizi, A. The processivity and fidelity of DNA synthesis exhibited by the reverse transcriptase of bovine leukemia virus. *European Journal of Biochemistry* 269, 859-867 (2002).

Gerard, G. F. et al. The role of template-primer in protection of reverse transcriptase from thermal inactivation. *Nucleic Acids Res* 30, 3118-3129 (2002).

Monot, C. et al. The Specificity and Flexibility of L1 Reverse Transcription Priming at Imperfect T-Tracts. *PLOS Genetics* 9, e1003499 (2013).

Mohr, S. et al. Thermostable group II intron reverse transcriptase fusion proteins and their use in cDNA synthesis and next-generation RNA sequencing. *RNA* 19, 958-970 (2013).

Any of the references noted above which relate to reverse transcriptases are hereby incorporated by reference in their entireties, if not already stated so.

[4] PE Fusion Proteins

The prime editor (PE) system described herein contemplate fusion proteins comprising a napDNAbp and a polymerase (e.g., DNA-dependent DNA polymerase or RNA-dependent DNA polymerase, such as, reverse transcriptase), and optionally joined by a linker. The application contemplates any suitable napDNAbp and polymerase (e.g., DNA-dependent DNA polymerase or RNA-dependent DNA polymerase, such as, reverse transcriptase) to be combined in a single fusion protein. Examples of napDNAbps and polymerases (e.g., DNA-dependent DNA polymerase or RNA-dependent DNA polymerase, such as, reverse transcriptase) are each defined herein. Since polymerases are well-known in the art, and the amino acid sequences are readily available, this disclosure is not meant in any way to be limited to those specific polymerases identified herein.

In various embodiments, the fusion proteins may comprise any suitable structural configuration. For example, the fusion protein may comprise from the N-terminus to the C-terminus direction, a napDNAbp fused to a polymerase (e.g., DNA-dependent DNA polymerase or RNA-dependent DNA polymerase, such as, reverse transcriptase). In other embodiments, the fusion protein may comprise from the N-terminus to the C-terminus direction, a polymerase (e.g., a reverse transcriptase) fused to a napDNAbp. The fused domain may optionally be joined by a linker, e.g., an amino acid sequence. In other embodiments, the fusion proteins may comprise the structure $NH_2$-[napDNAbp]-[polymerase]-COOH; or $NH_2$-[polymerase]-[napDNAbp]-COOH, wherein each instance of "]-[" indicates the presence of an optional linker sequence. In embodiments wherein the polymerase is a reverse transcriptase, the fusion proteins may comprise the structure $NH_2$-[napDNAbp]-[RT]-COOH; or $NH_2$-[RT]-[napDNAbp]-COOH, wherein each instance of "]-[" indicates the presence of an optional linker sequence.

An exemplary fusion protein is depicted in FIG. 14, which shows a fusion protein comprising an MLV reverse transcriptase ("MLV-RT") fused to a nickase Cas9 ("Cas9 (H840A)") via a linker sequence. This example is not intended to limit scope of fusion proteins that may be utilized for the prime editor (PE) system described herein.

In various embodiments, the prime editor fusion protein may have the following amino acid sequence (referred to herein as "PE1"), which includes a Cas9 variant comprising an H840A mutation (i.e., a Cas9 nickase) and an M-MLV RT wild type, as well as an N-terminal NLS sequence (19 amino acids) and an amino acid linker (32 amino acids) that joins the C-terminus of the Cas9 nickase domain to the N-terminus of the RT domain. The PE1 fusion protein has the following structure: [NLS]-[Cas9(H840A)]-[linker]-[MMLV_RT(wt)]. The amino acid sequence of PE1 and its individual components are as follows:

| DESCRIPTION | SEQUENCE |
|---|---|
| PE1 FUSION PROTEIN CAS9 (H840A)- MMLV_RT (WT) | MKRTADGSEFESPKKKRKVDKKYSIGLDIGTNSVGWAVITDEYKVPS KKFKVLGNTDRHSIKKNLIGALLFDSGETAEATRLKRTARRRYTRR KNRICYLQEIFSNEMAKVDDSFFHRLEESFLVEEDKKHERHPIFGNI VDEVAYHEKYPTIYHLRKKLVDSTDKADLRLIYLALAHMIKFRGHF LIEGDLNPDNSDVDKLFIQLVQTYNQLFEENPINASGVDAKAILSAR LSKSRRLENLIAQLPGEKKNGLFGNLIALSLGLTPNFKSNFDLAEDA KLQLSKDTYDDDLDNLLAQIGDQYADLFLAAKNLSDAILLSDILRV NTEITKAPLSASMIKRYDEHHQDLTLLKALVRQQLPEKYKEIFFDQ SKNGYAGYIDGGASQEEFYKFIKPILEKMDGTEELLVKLNREDLLR KQRTFDNGSIPHQIHLGELHAILRRQEDFYPFLKDNREKIEKILTFR IPYYVGPLARGNSRFAWMTRKSEETITPWNFEEVVDKGASAQSFIE RMTNFDKNLPNEKVLPKHSLLYEYFTVYNELTKVKYVTEGMRKPA FLSGEQKKAIVDLLFKTNRKVTVKQLKEDYFKKIECFDSVEISGVE |

| DESCRIPTION | SEQUENCE |
|---|---|
| | DRFNASLGTYHDLLKIIKDKDFLDNEENEDILEDIVLTLTLFEDREM<br>IEERLKTYAHLFDDKVMKQLRRRYTGWGRLSRKLINGIRDKQSG<br>KTILDFLKSDGFANRNFMQLIHDDSLTFKEDIQKAQVSGQGDSLHE<br>HIANLAGSPAIKKGILQTVKVVDELVKVMGRHKPENIVIEMARENQ<br>TTQKGQKNSRERMKRIEEGIKELGSQILKEHPVENTQLQNEKLYL<br>YYLQNGRDMYVDQELDINRLSDYDVDAIVPQSFLKDDSIDNKVLTR<br>SDKNRGKSDNVPSEEVVKKMKNYWRQLLNAKLITQRKFDNLTKA<br>ERGGLSELDKAGFIKRQLVETRQITKHVAQILDSRMNTKYDENDK<br>LIREVKVITLKSKLVSDFRKDFQFYKVREINNYHHAHDAYLNAVVG<br>TALIKKYPKLESEFVYGDYKVYDVRKMIAKSEQEIGKATAKYFFYS<br>NIMNFFKTEITLANGEIRKRPLIETNGETGEIVWDKGRDFATVRKV<br>LSMPQVNIVKKTEVQTGGFSKESILPKRNSDKLIARKKDWDPKKY<br>GGFDSPTVAYSVLVVAKVEKGKSKKLKSVKELLGITIMERSSFEKNP<br>IDFLEAKGYKEVKKDLIIKLPKYSLFELENGRKRMLASAGELQKG<br>NELALPSKYVNFLYLASHYEKLKGSPEDNEQKQLFVEQHKYLDE<br>IIEQISEFSKRVILADANLDKVLSAYNKHRDKPIREQAENIIHLFTLT<br>NLGAPAAFKYFDTTIDRKRYTSTKEVLDATLIHQSITGLYETRIDLS<br>QLGGDSGGSSGGSSGSETPGTSESATPESSGGSSGGSS*TLNIEDEYRLH<br>ETSKEPDVSLGSTWLSDFPQAWAETGGMGLAVRQAPLIIPLKATSTPVSIKQ<br>YPMSQEARLGIKPHIQRLLDQGILVPCQSPWNTPLLPVKKPGTNDYRPVQD<br>LREVNKRVEDIHPTVPNPYNLLSGLPPSHQWYTVLDLKDAFFCLRLHPTSQ<br>PLFAFEWRDPEMGISGQLTWTRLPQGFKNSPTLFDEALHRDLADFRIQHP<br>DLILLQYVDDLLLAATSELDCQQGTRALLQTLGNLGYRASAKKAQICQKQV<br>KYLGYLLKEGQRWLTEARKETVMGQPTPKTPRQLREFLGTAGFCRLWIPG<br>FAEMAAPLYPLTKTGTLFNWGPDQQKAYQEIKQALLTAPALGLPDLTKPFE<br>LFVDEKQGYAKGVLTQKLGPWRRPVAYLSKKLDPVAAGWPPCLRMVAAIAV<br>LTKDAGKLTMGQPLVILAPHAVEALVKQPPDRWLSNARMTHYQALLLDTD<br>RVQFGPVVALNPATLLPLPEEGLQHNCLDILAEAHGTRPDLTDQPLPDADH<br>TWYTDGSSLLQEGQRKAGAAVTTETEVIWAKALPAGTSAQRAELIALTQALK<br>MAEGKKLNVYTDSRYAFATAHIHGEIYRRRGLLTSEGKEIKNKDEILALLKAL<br>FLPKRLSIIHCPGHQKGHSAEARGNRMADQAARKAAITETPDTSTLLIENSS<br>PSGGSKRTADGSEFEPKKKRKV* (SEQ ID NO: 123)<br>KEY:<br><u>NUCLEAR LOCALIZATION SEQUENCE (NLS)</u> TOP: (SEQ ID NO: 124),<br>BOTTOM: (SEQ ID NO: 133)<br>CAS9 (H840A) (SEQ ID NO: 126)<br><u>33-AMINO ACID LINKER</u> (SEQ ID NO: 127)<br>*M-MLV REVERSE TRANSCRIPTASE* (SEQ ID NO: 128) |
| PE1-N-<br>TERMINAL<br>NLS | MKRTADGSEFESPKKKRKV (SEQ ID NO: 124) |
| PE1-CAS9<br>(H840A)<br>(MET<br>MINUS) | DKKYSIGLDIGTNSVGWAVITDEYKVPSKKFKVLGNTDRHSIKKNLIGA<br>LLFDSGETAEATRLKRTARRRYTRRKNRICYLQEIFSNEMAKVDDSFFH<br>RLEESFLVEEDKKHERHPIFGNIVDEVAYHEKYPTIYHLRKKLVSTDEK<br>ADLRLIYLALAHMIKFRGHFLIEGDLNPDNSDVDKLFIQLVQTYNQLFE<br>ENPINASGVDAKAILSARLSKSRRLENLIAQLPGEKKNGLFGNLIALSLG<br>LTPNFKSNFDLAEDAKLQLSKDTYDDDLDNLLAQIGDQYADLFLAAKN<br>LSDAILLSDILRVNTEITKAPLSASMIKRYDEHHQDLTLLKALVRQQLPE<br>KYKEIFFDQSKNGYAGYIDGGASQEEFYKFIKPILEKMDGTEELLVKLN<br>REDLLRKQRTFDNGSIPHQIHLGELHAILRRQEDFYPFLKDNREKIEKIL<br>TFRIPYYVGPLARGNSRFAWMTRKSEETITPWNFEEVVDKGASAQSFIE<br>RMTNFDKNLPNEKVLPKHSLLYEYFTVYNELTKVKYVTEGMRKPAFLS<br>GEQKKAIVDLLFKTNRKVTVKQLKEDYFKKIECFDSVEISGVEDRFNA<br>SLGTYHDLLKIIKDKDFLDNEENEDILEDIVLTLTLFEDREMIEERLKTY<br>AHLFDDKVMKQLRRRYTGWGRLSRKLINGIRDKQSGKTILDFLKSD<br>GFANRNFMQLIHDDSLTFKEDIQKAQVSGQGDSLHEHIANLAGSPAIKK<br>GILQTVKVVDELVKVMGRHKPENIVIEMARENQTTQKGQKNSRERMK<br>RIEEGIKELGSQILKEHPVENTQLQNEKLYLYYLQNGRDMYVDQELDIN<br>RLSDYDVDAIVPQSFLKDDSIDNKVLTRSDKNRGKSDNVPSEEVVKKM<br>KNYWRQLLNAKLITQRKFDNLTKAERGGLSELDKAGFIKRQLVETRQI<br>TKHVAQILDSRMNTKYDENDKLIREVKVITLKSKLVSDFRKDFQFYKV<br>REINNYHHAHDAYLNAVVGTALIKKYPKLESEFVYGDYKVYDVRKMI<br>AKSEQEIGKATAKYFFYSNIMNFFKTEITLANGEIRKRPLIETNGETGEIV<br>WDKGRDFATVRKVLSMPQVNIVKKTEVQTGGFSKESILPKRNSDKLIA<br>RKKDWDPKKYGGFDSPTVAYSVLVVAKVEKGKSKKLKSVKELLGITIM<br>ERSSFEKNPIDFLEAKGYKEVKKDLIIKLPKYSLFELENGRKRMLASAG<br>ELQKGNELALPSKYVNFLYLASHYEKLKGSPEDNEQKQLFVEQHKHY<br>LDEIIEQISEFSKRVILADANLDKVLSAYNKHRDKPIREQAENIIHLFTLT<br>NLGAPAAFKYFDTTIDRKRYTSTKEVLDATLIHQSITGLYETRIDLSQLG<br>GD (SEQ ID NO: 130) |
| PE1-<br>LINKER<br>BETWEEN<br>CAS 9<br>DOMAIN | SGGSSGGSSGSETPGTSESATPESSGGSSGGSS (SEQ ID NO: 127) |

-continued

| DESCRIPTION | SEQUENCE |
|---|---|
| AND RT DOMAIN (33 AMINO ACIDS) | |
| PE-M-MLV RT | TLNIEDEYRLHETSKEPDVSLGSTWLSDFPQAWAETGGMGLAVRQAPL<br>IIPLKATSTPVSIKQYPMSQEARLGIKPHIQRLLDQGILVPCQSPWNTPLL<br>PVKKPGTNDYRPVQDLREVNKRVEDIHPTVPNPYNLLSGLPPSHQWYT<br>VLDLKDAFFCLRLHPTSQPLFAFEWRDPEMGISGQLTWTRLPQGFKNSP<br>TLFDEALHRDLADFRIQHPDLILLQYVDDLLLAATSELDCQQGTRALLQ<br>TLGNLGYRASAKKAQICQKQVKYLGYLLKEGQRWLTEARKETVMGQ<br>PTPKTPRQLREFLGTAGFCRLWIPGFAEMAAPLYPLTKTGTLFNWGPDQ<br>QKAYQEIKQALLTAPALGLPDLTKPFELFVDEKQGYAKGVLTQKLGPW<br>RRPVAYLSKKLDPVAAGWPPCLRMVAAIAVLTKDAGKLTMGQPLVILA<br>PHAVEALVKQPPDRWLSNARMTHYQALLLDTDRVQFGPVVALNPATLL<br>PLPEEGLQHNCLDILAEAHGTRPDLTDQPLPDADHTWYTDGSSLLQEG<br>QRKAGAAVTTETEVIWAKALPAGTSAQRAELIALTQALKMAEGKKLN<br>VYTDSRYAFATAHIHGEIYRRRGLLTSEGKEIKNKDEILALLKALFLPKR<br>LSIIHCPGHQKGHSAEARGNRMADQAARKAAITETPDTSTLLIENSSP<br>(SEQ ID NO: 132) |
| PE1-C-TERMINAL NLS | SGGSKRTADGSEFEPKKKRKV (SEQ ID NO: 133) |

In another embodiment, the prime editor fusion protein may have the following amino acid sequence (referred to herein as "PET"), which includes a Cas9 variant comprising an H840A mutation (i.e., a Cas9 nickase) and an M-MLV RT comprising mutations D200N, T330P, L603W, T306K, and W313F, as well as an N-terminal NLS sequence (19 amino acids) and an amino acid linker (33 amino acids) that joins the C-terminus of the Cas9 nickase domain to the N-terminus of the RT domain. The PE2 fusion protein has the following structure: [NLS]-[Cas9(H840A)]-[linker]-[MMLV_RT(D200N)(T330P)(L603W)(T306K)(W313F)]. The amino acid sequence of PE2 is as follows:

| PE2 FUSION PROTEIN CAS 9 (H840A)- MMLV_RT D200N T330P L603W T306K W313F | MKRTADGSEFESPKKKRKVDKKYSIGLDIGTNSVGWAVITDEYKVPS<br>KKFKVLGNTDRHSIKKNLIGALLFDSGETAEATRLKRTARRRYTRR<br>KNRICYLQEIFSNEMAKVDDSFFHRLEESFLVEEDKKHERHPIFGNI<br>VDEVAYHEKYPTIYHLRKKLVDSTDKADLRLIYLALAHMIKFRGHF<br>LIEGDLNPDNSDVDKLFIQLVQTYNQLFEENPINASGVDAKAILSAR<br>LSKSRRLENLIAQLPGEKKNGLFGNLIALSLGLTPNFKSNFDLAEDA<br>KLQLSKDTYDDDLDNLLAQIGDQYADLFLAAKNLSDAILLSDILRV<br>NTEITKAPLSASMIKRYDEHHQDLTLLKALVRQQLPEKYKEIFFDQ<br>SKNGYAGYIDGGASQEEFYKFIKPILEKMDGTEELLVKLNREDLLR<br>KQRTFDNGSIPHQIHLGELHAILRRQEDFYPFLKDNREKIEKILTFR<br>IPYYVGPLARGNSRFAWMTRKSEETITPWNFEEVVDKGASAQSFIE<br>RMTNFDKNLPNEKVLPKHSLLYEYFTVYNELTKVKYVTEGMRKPA<br>FLSGEQKKAIVDLLFKTNRKVTVKQLKEDYFKKIECFDSVEISGVE<br>DRFNASLGTYHDLLKIIKDKDFLDNEENEDILEDIVLTLTLFEDREM<br>IEERLKTYAHLFDDKVMKQLKRRRYTGWGRLSRKLINGIRDKQSG<br>KTILDFLKSDGFANRNFMQLIHDDSLTFKEDIQKAQVSGQGDSLHE<br>HIANLAGSPAIKKGILQTVKVVDELVKVMGRHKPENIVIEMARENQ<br>TTQKGQKNSRERMKRIEEGIKELGSQILKEHPVENTQLQNEKLYL<br>YYLQNGRDMYVDQELDINRLSDYDVDAIVPQSFLKDDSIDNKVLTR<br>SDKNRGKSDNVPSEEVVKKMKNYWRQLLNAKLITQRKFDNLTKA<br>ERGGLSELDKAGFIKRQLVETRQITKHVAQILDSRMNTKYDENDK<br>LIREVKVITLKSKLVSDFRKDFQFYKVREINNYHHAHDAYLNAVVG<br>TALIKKYPKLESEFVYGDYKVYDVRKMIAKSEQEIGKATAKYFFYS<br>NIMNFFKTEITLANGEIRKRPLIETNGETGEIVWDKGRDFATVRKV<br>LSMPQVNIVKKTEVQTGGFSKESILPKRNSDKLIARKKDWDPKKY<br>GGFDSPTVAYSVLVVAKVEKGKSKKLKSVKELLGITIMERSSFEKNP<br>IDFLEAKGYKEVKKDLIIKLPKYSLFELENGRKRMLASAGELQKG<br>NELALPSKYVNFLYLASHYEKLKGSPEDNEQKQLFVEQHKHYLDE<br>IIEQISEFSKRVILADANLDKVLSAYNKHRDKPIREQAENIIHLFTLT<br>NLGAPAAFKYFDTTIDRKRYTSTKEVLDATLIHQSITGLYETRIDLS<br>QLGGD*SGGSSGGSSGSETPGTSESATPESSGGSSGGSS*TLNIEDEYRLH<br>*ETSKEPDVSLGSTWLSDFPQAWAETGGMGLAVRQAPLI*IPLKATSTPVSIKQ<br>*YPMSQEARLGIKPHIQRLLDQGILVPCQSPWNTPLL*PVKKPGTNDYRPVQD<br>*LREVNKRVEDIHPTVPNPYNLLSGLPPSHQWYTVLDLKDAFFCLRLHPTSQ*<br>*PLFAFEWRDPEMGISGQLTWTRLPQGFKNSPTLFNEALHRDLADFRIQHP*<br>*DLILLQYVDDLLLAATSELDCQQGTRALLQTLGNLGYRASAKKAQICQKQV*<br>*KYLGYLLKEGQRWLTEARKETVMGQPTPKTPRQLREFLGKAGFCRLFIPG*<br>*FAEMAAPLYPLTKPGTLFNWGPDQQKAYQEIKQALLTAPALGLPDLTKPFE*<br>*LFVDEKQGYAKGVLTQKLGPWRRPVAYLSKKLDPVAAGWPPCLRMVAAIAV*<br>*LTKDAGKLTMGQPLVILAPHAVEALVKQPPDRWLSNARMTHYQALLLDTD*<br>*RVQFGPVVALNPATLLPLPEEGLQHNCLDILAEAHGTRPDLTDQPLPDADH*<br>*TWYTDGSSLLQEGQRKAGAAVTTETEVIWAKALPAGTSAQRAELIALTQALK* |

-continued

```
            MAEGKKLNVYTDSRYAFATAHIHGEIYRRRGWLTSEGKEIKNKDEILALLKA
            LFLPKRLSIIHCPGHQKGHSAEARGNRMADQAARKAAITETPDTSTLLIENS
            SPSGGSKRTADGSEFEPKKKRKV (SEQ ID NO: 134)
            KEY:
            NUCLEAR LOCALIZATION SEQUENCE (NLS) TOP:(SEQ ID NO: 124),
            BOTTOM: (SEQ ID NO: 133)
            CAS9(H840A) (SEQ ID NO: 137)
            33-AMINO ACID LINKER (SEQ ID NO: 127)
            M-MLV REVERSE TRANSCRIPTASE (SEQ ID NO: 139)

PE2-N-      MKRTADGSEFESPKKKRKV (SEQ ID NO: 124)
TERMINAL
NLS

PE2-CAS9    DKKYSIGLDIGTNSVGWAVITDEYKVPSKKFKVLGNTDRHSIKKNLIGA
(H840A)     LLFDSGETAEATRLKRTARRRYTRRKNRICYLQEIFSNEMAKVDDSFFH
(MET        RLEESFLVEEDKKHERHPIFGNIVDEVAYHEKYPTIYHLRKKLVDSTDK
MINUS)      ADLRLIYLALAHMIKFRGHFLIEGDLNPDNSDVDKLFIQLVQTYNQLFE
            ENPINASGVDAKAILSARLSKSRRLENLIAQLPGEKKNGLFGNLIALSLG
            LTPNFKSNFDLAEDAKLQLSKDTYDDDLDNLLAQIGDQYADLFLAAKN
            LSDAILLSDILRVNTEITKAPLSASMIKRYDEHHQDLTLLKALVRQQLPE
            KYKEIFFDQSKNGYAGYIDGGASQEEFYKFIKPILEKMDGTEELLVKLN
            REDLLRKQRTFDNGSIPHQIHLGELHAILRRQEDFYPFLKDNREKIEKIL
            TFRIPYYVGPLARGNSRFAWMTRKSEETITPWNFEEVVDKGASAQSFIE
            RMTNFDKNLPNEKVLPKHSLLYEYFTVYNELTKVKYVTEGMRKPAFLS
            GEQKKAIVDLLFKTNRKVTVKQLKEDYFKKIECFDSVEISGVEDRFNA
            SLGTYHDLLKIIKDKDFLDNEENEDILEDIVLTLTLFEDREMIEERLKTY
            AHLFDDKVMKQLKRRRYTGWGRLSRKLINGIRDKQSGKTILDFLKSD
            GFANRNFMQLIHDDSLTFKEDIQKAQVSGQGDSLHEHIANLAGSPAIKK
            GILQTVKVVDELVKVMGRHKPENIVIEMARENQTTQKGQKNSRERMK
            RIEEGIKELGSQILKEHPVENTQLQNEKLYLYYLQNGRDMYVDQELDIN
            RLSDYDVDAIVPQSFLKDDSIDNKVLTRSDKNRGKSDNVPSEEVVKKM
            KNYWRQLLNAKLITQRKFDNLTKAERGGLSELDKAGFIKRQLVETRQI
            TKHVAQILDSRMNTKYDENDKLIREVKVITLKSKLVSDFRKDFQFYKV
            REINNYHHAHDAYLNAVVGTALIKKYPKLESEFVYGDYKVYDVRKMI
            AKSEQEIGKATAKYFFYSNIMNFFKTEITLANGEIRKRPLIETNGETEIV
            WDKGRDFATVRKVLSMPQVNIVKKTEVQTGGFSKESILPKRNSDKLIA
            RKKDWDPKKYGGFDSPTVAYSVLVVAKVEKGKSKKLKSVKELLGITIM
            ERSSFEKNPIDFLEAKGYKEVKKDLIIKLPKYSLFELENGRKRMLASAG
            ELQKGNELALPSKYVNFLYLASHYEKLKGSPEDNEQKQLFVEQHKHY
            LDEIIEQISEFSKRVILADANLDKVLSAYNKHRDKPIREQAENIIHLFTLT
            NLGAPAAFKYFDTTIDRKRYTSTKEVLDATLIHQSITGLYETRIDLSQLG
            GD (SEQ ID NO: 141)

PE2-        SGGSSGGSSGSETPGTSESATPESSGGSSGGSS (SEQ ID NO: 127)
LINKER
BETWEEN
CAS9
DOMAIN
AND RT
DOMAIN (33
AMINO
ACIDS)

PE2-        TLNIEDEYRLHETSKEPDVSLGSTWLSDFPQAWAETGGMGLAVRQAPL
MMLV_RT     IIPLKATSTPVSIKQYPMSQEARLGIKPHIQRLLDQGILVPCQSPWNTPLL
D200N       PVKKPGTNDYRPVQDLREVNKRVEDIHPTVPNPYNLLSGLPPSHQWYT
T330P       VLDLKDAFFCLRLHPTSQPLFAFEWRDPEMGISGQLTWTRLPQGFKNSP
L603W       TLFNEALHRDLADFRIQHPDLILLQYVDDLLLAATSELDCQQGTRALLQ
T306K       TLGNLGYRASAKKAQICQKQVKYLGYLLKEGQRWLTEARKETVMGQ
W313F       PTPKTPRQLREFLGKAGFCRLFIPGFAEMAAPLYPLTKPGTLFNWGPDQ
            QKAYQEIKQALLTAPALGLPDLTKPFELFVDEKQGYAKGVLTQKLGPW
            RRPVAYLSKKLDPVAAGWPPCLRMVAAIAVLTKDAGKLTMGQPLVILA
            PHAVEALVKQPPDRWLSNARMTHYQALLLDTDRVQFGPVVALNPATLL
            PLPEEGLQHNCLDILAEAHGTRPDLTDQPLPDADHTWYTDGSSLLQEG
            QRKAGAAVTTETEVIWAKALPAGTSAQRAELIALTQALKMAEGKKLN
            VYTDSRYAFATAHIHGEIYRRRGWLTSEGKEIKNKDEILALLKALFLPKR
            LSIIHCPGHQKGHSAEARGNRMADQAARKAAITETPDTSTLLIENSSP
            (SEQ ID NO: 143)

PE2-C-      SGGSKRTADGSEFEPKKKRKV (SEQ ID NO: 133)
TERMINAL
NLS
```

In still other embodiments, the prime editor fusion protein may have the following amino acid sequences:

| | |
|---|---|
| PE FUSION PROTEIN MMLV_RT (WT) 32AA-CAS9 (H840A) | MKRTADGSEFESPKKKRKVTLNIEDEYRLHETSKEPDVSLGSTWLSDFPQ<br>AWAETGGMGLAVRQAPLIIPLKATSTPVSIKQYPMSQEARLGIKPHIQRLLD<br>QGILVPCQSPWNTPLLPVKKPGTNDYRPVQDLREVNKRVEDIHPTVPNPYN<br>LLSGLPPSHQWYTVLDLKDAFFCLRLHPTSQPLFAFEWRDPEMGISGQLT<br>WTRLPQGFKNSPTLFDEALHRDLADFRIQHPDLILLQYVDDLLLAATSELD<br>CQQGTRALLQTLGNLGYRASAKKAQICQKQVKYLGYLLKEGQRWLTEARK<br>ETVMGQPTPKTPRQLREFLGTAGFCRLWIPGFAEMAAPLYPLTKTGTLFNW<br>GPDQQKAYQEIKQALLTAPALGLPDLTKPFELFVDEKQGYAKGVLTQKLGP<br>WRRPVAYLSKKLDPVAAGWPPCLRMVAAIAVLTKDAGKLTMGQPLVILAPH<br>AVEALVKQPPDRWLSNARMTHYQALLLDTDRVQFGPVVALNPATLLPLPEE<br>GLQHNCLDILAEAHGTRPDLTDQPLPDADHTWYTDGSSLLQEGQRKAGAA<br>VTTETEVIWAKALPAGTSAQRAELIALTQALKMAEGKKLNVYTDSRYAFATAH<br>IHGEIYRRGLLTSEGKEIKNKDEILALLKALFLPKRLSIIHCPGHQKGHSAE<br>ARGNRMADQAARKAAITETPDTSTLLIENSSPSGGSSGGSSGSETPGTSES<br>ATPESSGGSSGGSSDKKYSIGLDIGTNSVGWAVITDEYKVPSKKFKV<br>LGNTDRHSIKKNLIGALLFDSGETAEATRLKRTARRRYTRRKNRIC<br>YLQEIFSNEMAKVDDSFFHRLEESFLVEEDKKHERHPIFGNIVDEVA<br>YHEKYPTIYHLRKKLVDSTDKADLRLIYLALAHMIKFRGHFLIEGD<br>LNPDNSDVDKLFIQLVQTYNQLFEENPINASGVDAKAILSARLSKSR<br>RLENLIAQLPGEKKNGLFGNLIALSLGLTPNFKSNFDLAEDAKLQL<br>SKDTYDDDLDNLLAQIGDQYADLFLAAKNLSDAILLSDILRVNTEIT<br>KAPLSASMIKRYDEHHQDLTLLKALVRQQLPEKYKEIFFDQSKNG<br>YAGYIDGGASQEEFYKFIKPILEKMDGTEELLVKLNREDLLRKQRT<br>FDNGSIPHQIHLGELHAILRRQEDFYPFLKDNREKIEKILTFRIPYYV<br>GPLARGNSRFAWMTRKSEETITPWNFEEVVDKGASAQSFIERMTN<br>FDKNLPNEKVLPKHSLLYEYFTVYNELTKVKYVTEGMRKPAFLSG<br>EQKKAIVDLLFKTNRKVTVKQLKEDYFKKIECFDSVEISGVEDRFN<br>ASLGTYHDLLKIIKDKDFLDNEENEDILEDIVLTLTLFEDREMIEER<br>LKTYAHLFDDKVMKQLKRRRYTGWGRLSRKLINGIRDKQSGKTIL<br>DFLKSDGFANRNFMQLIHDDSLTFKEDIQKAQVSGQGDSLHEHIAN<br>LAGSPAIKKGILQTVKVVDELVKVMGRHKPENIVIEMARENQTTQ<br>KGQKNSRERMKRIEEGIKELGSQILKEHPVENTQLQNEKLYLYYL<br>QNGRDMYVDQELDINRLSDYDVDAIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIRE<br>VKVITLKSKLVSDFRKDFQFYKVREINNYHHAHDAYLNAVVGTALI<br>KKYPKLESEFVYGDYKVYDVRKMIAKSEQEIGKATAKYFFYSNIM<br>NFFKTEITLANGEIRKRPLIETNGETGEIVWDKGRDFATVRKVLSM<br>PQVNIVKKTEVQTGGFSKESILPKRNSDKLIARKKDWDPKKYGGF<br>DSPTVAYSVLVVAKVEKGKSKKLKSVKELLGITIMERSSFEKNPIDF<br>LEAKGYKEVKKDLIIKLPKYSLFELENGRKRMLASAGELQKGNEL<br>ALPSKYVNFLYLASHYEKLKGSPEDNEQKQLFVEQHKHYLDEIIEQ<br>ISEFSKRVILADANLDKVLSAYNKHRDKPIREQAENIIHLFTLTNLG<br>APAAFKYFDTTIDRKRYTSTKEVLDATLIHQSITGLYETRIDLSQLG<br>GDSGGSKRTADGSEFEPKKKRKV (SEQ ID NO: 145)<br>KEY:<br>NUCLEAR LOCALIZATION SEQUENCE (NLS) TOP:(SEQ ID NO: 124),<br>BOTTOM: (SEQ ID NO: 133)<br>CAS9(H840A) (SEQ ID NO: 147)<br>33-AMINO ACID LINKER (SEQ ID NO: 127)<br>M-MLV REVERSE TRANSCRIPTASE (SEQ ID NO: 149) |
| PE FUSION PROTEIN MMLV_RT (WT)- 60AA-CAS9 (H840A | MKRTADGSEFESPKKKRKVTLNIEDEYRLHETSKEPDVSLGSTWLSDFPQ<br>AWAETGGMGLAVRQAPLIIPLKATSTPVSIKQYPMSQEARLGIKPHIQRLLD<br>QGILVPCQSPWNTPLLPVKKPGTNDYRPVQDLREVNKRVEDIHPTVPNPYN<br>LLSGLPPSHQWYTVLDLKDAFFCLRLHPTSQPLFAFEWRDPEMGISGQLT<br>WTRLPQGFKNSPTLFDEALHRDLADFRIQHPDLILLQYVDDLLLAATSELD<br>CQQGTRALLQTLGNLGYRASAKKAQICQKQVKYLGYLLKEGQRWLTEARK<br>ETVMGQPTPKTPRQLREFLGTAGFCRLWIPGFAEMAAPLYPLTKTGTLFNW<br>GPDQQKAYQEIKQALLTAPALGLPDLTKPFELFVDEKQGYAKGVLTQKLGP<br>WRRPVAYLSKKLDPVAAGWPPCLRMVAAIAVLTKDAGKLTMGQPLVILAPH<br>AVEALVKQPPDRWLSNARMTHYQALLLDTDRVQFGPVVALNPATLLPLPEE<br>GLQHNCLDILAEAHGTRPDLTDQPLPDADHTWYTDGSSLLQEGQRKAGAA<br>VTTETEVIWAKALPAGTSAQRAELIALTQALKMAEGKKLNVYTDSRYAFATAH<br>IHGEIYRRGLLTSEGKEIKNKDEILALLKALFLPKRLSIIHCPGHQKGHSAE<br>ARGNRMADQAARKAAITETPDTSTLLIENSSPSGGSSGGSSGSETPGTSES<br>ATPESAGSYPYDVPDYAGSAAPAAKKKKLDGSGSGGSSGGSDKKYS<br>IGLDIGTNSVGWAVITDEYKVPSKKFKVLGNTDRHSIKKNLIGALLF<br>DSGETAEATRLKRTARRRYTRRKNRICYLQEIFSNEMAKVDDSFFH<br>RLEESFLVEEDKKHERHPIFGNIVDEVAYHEKYPTIYHLRKKLVDST<br>DKADLRLIYLALAHMIKFRGHFLIEGDLNPDNSDVDKLFIQLVQTY<br>NQLFEENPINASGVDAKAILSARLSKSRRLENLIAQLPGEKKNGLF<br>GNLIALSLGLTPNFKSNFDLAEDAKLQLSKDTYDDDLDNLLAQIGD<br>QYADLFLAAKNLSDAILLSDILRVNTEITKAPLSASMIKRYDEHHQD<br>LTLLKALVRQQLPEKYKEIFFDQSKNGYAGYIDGGASQEEFYKFIK<br>PILEKMDGTEELLVKLNREDLLRKQRTFDNGSIPHQIHLGELHAIL<br>RRQEDFYPFLKDNREKIEKILTFRIPYYVGPLARGNSRFAWMTRKS<br>EETITPWNFEEVVDKGASAQSFIERMTNFDKNLPNEKVLPKHSLLY |

```
            EYFTVYNELTKVKYVTEGMRKPAFLSGEQKKAIVDLLFKTNRKVT
            VKQLKEDYFKKIECFDSVEISGVEDRFNASLGTYHDLLKIIKDKDFL
            DNEENEDILEDIVLTLTLFEDREMIEERLKTYAHLFDDKVMKQLKR
            RRYTGWGRLSRKLINGIRDKQSGKTILDFLKSDGFANRNFMQLIHD
            DSLTFKEDIQKAQVSGQGDSLHEHIANLAGSPAIKKGILQTVKVVD
            ELVKVMGRHKPENIVIEMARENQTTQKGQKNSRERMKRIEEGIKE
            LGSQILKEHPVENTQLQNEKLYLYYLQNGRDMYVDQELDINRLSD
            YDVDAIVPQSFLKDDSIDNKVLTRSDKNRGKSDNVPSEEVVKKMKN
            YWRQLLNAKLITQRKFDNLTKAERGGLSELDKAGFIKRQLVETRQ
            ITKHVAQILDSRMNTKYDENDKLIREVKVITLKSKLVSDFRKDFQF
            YKVREINNYHHAHDAYLNAVVGTALIKKYPKLESEFVYGDYKVYD
            VRKMIAKSEQEIGKATAKYFFYSNIMNFFKTEITLANGEIRKRPLIE
            TNGETGEIVWDKGRDFATVRKVLSMPQVNIVKKTEVQTGGFSKES
            ILPKRNSDKLIARKKDWDPKKYGGFDSPTVAYSVLVVAKVEKGKSK
            KLKSVKELLGITIMERSSFEKNPIDFLEAKGYKEVKKDLIIKLPKYS
            LFELENGRKRMLASAGELQKGNELALPSKYVNFLYLASHYEKLKG
            SPEDNEQKQLFVEQHKHYLDEIIEQISEFSKRVILADANLDKVLSAY
            NKHRDKPIREQAENIIHLFTLTNLGAPAAFKYFDTTIDRKRYTSTKE
            VLDATLIHQSITGLYETRIDLSQLGGDSGGSKRTADGSEFEPKKKRKV
            (SEQ ID NO: 150)
            KEY:
            NUCLEAR LOCALIZATION SEQUENCE (NLS) TOP:(SEQ ID NO: 124),
            BOTTOM: (SEQ ID NO: 133)
            CAS9(H840A)(SEQ ID NO: 153)
            AMINO ACID LINKER (SEQ ID NO: 175)
            M-MLV REVERSE TRANSCRIPTASE (SEQ ID NO: 149)

PE FUSION    MKRTADGSEFESPKKKRKVDKKYSIGLDIGTNSVGWAVITDEYKVPS
PROTEIN      KKFKVLGNTDRHSIKKNLIGALLFDSGETAEATRLKRTARRRYTRR
CAS9         KNRICYLQEIFSNEMAKVDDSFFHRLEESFLVEEDKKHERHPIFGNI
(H840A)-
FEN1-        VDEVAYHEKYPTIYHLRKKLVDSTDKADLRLIYLALAHMIKFRGHF
MMLV_RT      LIEGDLNPDNSDVDKLFIQLVQTYNQLFEENPINASGVDAKAILSAR
D200N        LSKSRRLENLIAQLPGEKKNGLFGNLIALSLGLTPNFKSNFDLAEDA
T330P        KLQLSKDTYDDDLDNLLAQIGDQYADLFLAAKNLSDAILLSDILRV
L603W        NTEITKAPLSASMIKRYDEHHQDLTLLKALVRQQLPEKYKEIFFDQ
T306K        SKNGYAGYIDGGASQEEFYKFIKPILEKMDGTEELLVKLNREDLLR
W313F        KQRTFDNGSIPHQIHLGELHAILRRQEDFYPFLKDNREKIEKILTFR
             IPYYVGPLARGNSRFAWMTRKSEETITPWNFEEVVDKGASAQSFIE
             RMTNFDKNLPNEKVLPKHSLLYEYFTVYNELTKVKYVTEGMRKPA
             FLSGEQKKAIVDLLFKTNRKVTVKQLKEDYFKKIECFDSVEISGVE
             DRFNASLGTYHDLLKIIKDKDFLDNEENEDILEDIVLTLTLFEDREM
             IEERLKTYAHLFDDKVMKQLKRRRYTGWGRLSRKLINGIRDKQSG
             KTILDFLKSDGFANRNFMQLIHDDSLTFKEDIQKAQVSGQGDSLHE
             HIANLAGSPAIKKGILQTVKVVDELVKVMGRHKPENIVIEMARENQ
             TTQKGQKNSRERMKRIEEGIKELGSQILKEHPVENTQLQNEKLYL
             YYLQNGRDMYVDQELDINRLSDYDVDAIVPQSFLKDDSIDNKVLTR
             SDKNRGKSDNVPSEEVVKKMKNYWRQLLNAKLITQRKFDNLTKA
             ERGGLSELDKAGFIKRQLVETRQITKHVAQILDSRMNTKYDENDK
             LIREVKVITLKSKLVSDFRKDFQFYKVREINNYHHAHDAYLNAVVG
             TALIKKYPKLESEFVYGDYKVYDVRKMIAKSEQEIGKATAKYFFYS
             NIMNFFKTEITLANGEIRKRPLIETNGETGEIVWDKGRDFATVRKV
             LSMPQVNIVKKTEVQTGGFSKESILPKRNSDKLIARKKDWDPKKY
             GGFDSPTVAYSVLVVAKVEKGKSKKLKSVKELLGITIMERSSFEKNP
             IDFLEAKGYKEVKKDLIIKLPKYSLFELENGRKRMLASAGELQKG
             NELALPSKYVNFLYLASHYEKLKGSPEDNEQKQLFVEQHKHYLDE
             IIEQISEFSKRVILADANLDKVLSAYNKHRDKPIREQAENIIHLFTLT
             NLGAPAAFKYFDTTIDRKRYTSTKEVLDATLIHQSITGLYETRIDLS
             QLGGDSGGSSGGSSGSETPGTSESATPESSGGSSGGSSGIQGLAKLIA
             DVAPSAIRENDIKSYFGRKVAIDASMSIYQFLIAVRQGGDVLQNEEGETT
             SHLMGMFYRTIRMMENGIKPVYVFDGKPPQLKSGELAKRSERRAEAE
             KQLQQAQAAGAEQEVEKFTKRLVKVTKQHNDECKHLLSLMGIPYLDA
             PSEAEASCAALVKAGKVYAAATEDMDCLTFGSPVLMRHLTASEAKKLP
             IQEFHLSRILQELGLNQEQFVDLCILLGSDYCESIRGIGPKRAVDLIQKHK
             SIEEIVRRLDPNKYPVPENWLHKEAHQLFLEPEVLDPESVELKWSEPNE
             EELIKFMCGEKQFSEERIRSGVKRLSKSRQGSTQGRLDDFFKVTGSLSS
             AKRKEPEPKGSTKKKAKTGAAGKFKRGKSGGSSGGSSGSETPGTSES
             ATPESSGGSSGGSSTLNIEDEYRLHETSKEPDVSLGSTWLSDFPQAWAETG
             GMGLAVRQAPLIIPLKATSTPVSIKQYPMSQEARLGIKPHIQRLLDQGILVPC
             QSPWNTPLLVKKPGTNDYRPVQDLREVNKRVEDIHPTVPNPYNLLSGLPP
             SHQWYTVLDLKDAFFCLRLHPTSQPLFAFEWRDPEMGISGQLTWTRLPQG
             FKNSPTLFNEALHRDLADFRIQHPDLILLQYVDDLLLAATSELDCQQGTRA
             LLQTLGNLGYRASAKKAQICQKQVKYLGYLLKEGQRWLTEARKETVMGQP
             TPKTPRQLREFLGKAGFCRLFIPGFAEMAAPLYPLTKPGTLFNWGPDQQK
             AYQEIKQALLTAPALGLPDLTKPFELFVDEKQGYAKGVLTQKLGPWRRPVA
             YLSKKLDPVAAGWPPCLRMVAAIAVLTKDAGKLTMGQPLVILAPHAVEALV
             KQPPDRWLSNARMTHYQALLLDTDRVQFGPVVALNPATLLPLPEEGLQHN
             CLDILAEAHGTRPDLTDQPLPDADHTWYTDGSSLLQEGQRKAGAAVTTET
             EVIWAKALPAGTSAQRAELIALTQALKMAEGKKLNVYTDSRYAFATAHIHGEI
             YRRRGWLTSEGKEIKNKDEILALLKALFLPKRLSIIHCPGHQKGHSAEARGN
```

```
            RMADQAARKAAITETPDTSTLLIENSSPSGGSKRTADGSEFEPKKKRKV
            (SEQ ID NO: 154)
            KEY:
            NUCLEAR LOCALIZATION SEQUENCE (NLS) TOP:(SEQ ID NO: 124),
            BOTTOM: (SEQ ID NO: 133)
            CAS9(H840A) (SEQ ID NO: 157)
            33-AMINO ACID LINKER 1 (SEQ ID NO: 127)
            M-MLV REVERSE TRANSCRIPTASE (SEQ ID NO: 159)
            33-AMINO ACID LINKER 2 (SEQ ID NO: 127)
            FEN1 (SEQ ID NO: 161)
```

In other embodiments, the prime editor fusion proteins can be based on SaCas9 or on SpCas9 nickases with altered PAM specificities, such as the following exemplary sequences:

```
SACAS9-M-MLV      MKRTADGSEFESPKKKRKVGKRNYILGLDIGITSVGYGIIDYETR
RT PRIME EDITOR   DVIDAGVRLFKEANVENNEGRRSKRGARRLKRRRRHRIQRVKK
                  LLFDYNLLTDHSELSGINPYEARVKGLSQKLSEEEFSAALLHLA
                  KRRGVHNVNEVEEDTGNELSTKEQISRNSKALEEKYVAELQLE
                  RLKKDGEVRGSINRFKTSDYVKEAKQLLKVQKAYHQLDQSFID
                  TYIDLLETRRTYYEGPGEGSPFGWKDIKEWYEMLMGHCTYFPE
                  ELRSVKYAYNADLYNALNDLNNLVITRDENEKLEYYEKFQIIEN
                  VFKQKKKPTLKQIAKEILVNEEDIKGYRVTSTGKPEFTNLKVYH
                  DIKDITARKEIIENAELLDQIAKILTIYQSSEDIQEELTNLNSELTQE
                  EIEQISNLKGYTGTHNLSLKAINLILDELWHTNDNQIAIFNRLKL
                  VPKKVDLSQQKEIPTTLVDDFILSPVVKRSFIQSIKVINAIIKKYG
                  LPNDIIIELAREKNSKDAQKMINEMQKRNRQTNERIEEIIRTTGK
                  ENAKYLIEKIKLHDMQEGKCLYSLEAIPLEDLLNNPFNYEVDHII
                  PRSVSFDNSFNNKVLVKQEEASKKGNRTPFQYLSSSDSKISYETF
                  KKHILNLAKGKGRISKTKKEYLLEERDINRFSVQKDFINRNLVD
                  TRYATRGLMNLLRSYFRVNNLDVKVKSINGGFTSFLRRKWKFK
                  KERNKGYKHHAEDALIIANADFIFKEWKKLDKAKKVMENQMF
                  EEKQAESMPEIETEQEYKEIFITPHQIKHIKDFKDYKYSHRVDKK
                  PNRELINDTLYSTRKDDKGNTLIVNNLNGLYDKDNDKLKKLIN
                  KSPEKLLMYHHDPQTYQKLKLIMEQYGDEKNPLYKYYEETGN
                  YLTKYSKKDNGPVIKKIKYYGNKLNAHLDITDDYPNSRNKVVK
                  LSLKPYRFDVYLDNGVYKFVTVKNLDVIKKENYYEVNSKCYE
                  EAKKLKKISNQAEFIASFYNNDLIKINGELYRVIGVNNDLLNRIE
                  VNMIDITYREYLENMNDKRPPRIIKTIASKTQSIKKYSTDILGNL
                  YEVKSKKHPQIIKKGSGGSSGGSSGSETPGTSESATPESSGGSSG
                  GSSTLNIEDEYRLHETSKEPDVSLGSTWLSDFPQAWAETGGMGL
                  AVRQAPLIIPLKATSTPVSIKQYPMSQEARLGIKPHIQRLLDQGIL
                  VPCQSPWNTPLLPVKKPGTNDYRPVQDLREVNKRVEDIHPTVP
                  NPYNLLSGLPPSHQWYTVLDLKDAFFCLRLHPTSQPLFAFEWR
                  DPEMGISGQLTWTRLPQGFKNSPTLFDEALHRDLADFRIQHPDL
                  ILLQYVDDLLLAATSELDCQQGTRALLQTLGNLGYRASAKKAQ
                  ICQKQVKYLGYLLKEGQRWLTEARKETVMGQPTPKTPRQLREF
                  LGTAGFCRLWIPGFAEMAAPLYPLTKTGTLFNWGPDQQKAYQEI
                  KQALLTAPALGLPDLTKPFELFVDEKQGYAKGVLTQKLGPWRR
                  PVAYLSKKLDPVAAGWPPCLRMVAAIAVLTKDAGKLTMGQPLVI
                  LAPHAVEALVKQPPDRWLSNARMTHYQALLLDTDRVQFGPVV
                  ALNPATLLPLPEEGLQHNCLDILAEAHGTRPDLTDQPLPDADHT
                  WYTDGSSLLQEGQRKAGAAVTTETEVIWAKALPAGTSAQRAEL
                  IALTQALKMAEGKKLNVYTDSRYAFATAHIHGEIYRRRGLLTSE
                  GKEIKNKDEILALLKALFLPKRLSIIHCPGHQKGHSAEARGNRM
                  ADQAARKAAITETPDTSTLLIENSSPSGGSKRTADGSEFEPKKKR
                  KV (SEQ ID NO: 162)

SPCAS9(H840A)-    MKRTADGSEFESPKKKRKVDKKYSIGLDIGTNSVGWAVITDEY
VRQR-MALONEY      KVPSKKFKVLGNTDRHSIKKNLIGALLFDSGETAEATRLKRTAR
MURINE            RRYTRRKNRICYLQEIFSNEMAKVDDSFFHRLEESFLVEEDKKH
LEUKEMIA VIRUS    ERHPIFGNIVDEVAYHEKYPTIYHLRKKLVDSTDKADLRLIYLAL
REVERSE           AHMIKFRGHFLIEGDLNPDNSDVDKLFIQLVQTYNQLFEENPIN
TRANSCRIPTASE     ASGVDAKAILSARLSKSRRLENLIAQLPGEKKNGLFGNLIALSL
PRIME EDITOR      GLTPNFKSNFDLAEDAKLQLSKDTYDDDLDNLLAQIGDQYADL
                  FLAAKNLSDAILLSDILRVNTEITKAPLSASMIKRYDEHHQDLTL
                  LKALVRQQLPEKYKEIFFDQSKNGYAGYIDGGASQEEFYKFIKPI
                  LEKMDGTEELLVKLNREDLLRKQRTFDNGSIPHQIHLGELHAIL
                  RRQEDFYPFLKDNREKIEKILTFRIPYYVGPLARGNSRFAWMTR
                  KSEETITPWNFEEVVDKGASAQSFIERMTNFDKNLPNEKVLPKH
                  SLLYEYFTVYNELTKVKYVTEGMRKPAFLSGEQKKAIVDLLFKT
                  NRKVTVKQLKEDYFKKIECFDSVEISGVEDRFNASLGTYHDLL
                  KIIKDKDFLDNEENEDILEDIVLTLTLFEDREMIEERLKTYAHLFD
                  DKVMKQLKRRRYTGWGRLSRKLINGIRDKQSGKTILDFLKSDG
                  FANRNFMQLIHDDSLTFKEDIQKAQVSGQGDSLHEHIANLAGSP
```

```
                        AIKKGILQTVKVVDELVKVMGRHKPENIVIEMARENQTTQKGQ
                        KNSRERMKRIEEGIKELGSQILKEHPVENTQLQNEKLYLYYLQN
                        GRDMYVDQELDINRLSDYDVDAIVPQSFLKDDSIDNKVLTRSD
                        KNRGKSDNVPSEEVVKKMKNYWRQLLNAKLITQRKFDNLTKA
                        ERGGLSELDKAGFIKRQLVETRQITKHVAQILDSRMNTKYDEND
                        KLIREVKVITLKSKLVSDFRKDFQFYKVREINNYHHAHDAYLNA
                        VVGTALIKKYPKLESEFVYGDYKVYDVRKMIAKSEQEIGKATA
                        KYFFYSNIMNFFKTEITLANGEIRKRPLIETNGETGEIVWDKGRD
                        FATVRKVLSMPQVNIVKKTEVQTGGFSKESILPKRNSDKLIARK
                        KDWDPKKYGGFVSPTVAYSVLVVAKVEKGKSKKLKSVKELLGI
                        TIEVIERSSFEKNPIDFLEAKGYKEVKKDLIIKLPKYSLFELENGRK
                        RMLASARELQKGNELALPSKYVNFLYLASHYEKLKGSPEDNEQ
                        KQLFVEQHKHYLDEIIEQISEFSKRVILADANLDKVLSAYNKHR
                        DKPIREQAENIIHLFTLTNLGAPAAFKYFDTTIDRKQYRSTKEVL
                        DATLIHQSITGLYETRIDLSQLGGDSGGSSGGSSGSETPGTSESAT
                        PESSGGSSGGSSTLNIEDEYRLHETSKEPDVSLGSTWLSDFPQA
                        WAETGGMGLAVRQAPLIIPLKATSTPVSIKQYPMSQEARLGIKP
                        HIQRLLDQGILVPCQSPWNTPLLPVKKPGTNDYRPVQDLREVN
                        KRVEDIHPTVPNPYNLLSGLPPSHQWYTVLDLKDAFFCLRLHPT
                        SQPLFAFEWRDPEMGISGQLTWTRLPQGFKNSPTLFNEALHRDL
                        ADFRIQHPDLILLQYVDDLLLAATSELDCQQGTRALLQTLGNLG
                        YRASAKKAQICQKQVKYLGYLLKEGQRWLTEARKETVMGQPT
                        PKTPRQLREFLGKAGFCRLFIPGFAEMAAPLYPLTKPGTLFNWG
                        PDQQKAYQEIKQALLTAPALGLPDLTKPFELFVDEKQGYAKGVL
                        TQKLGPWRRPVAYLSKKLDPVAAGWPPCLRMVAAIAVLTKDAG
                        KLTMGQPLVILAPHAVEALVKQPPDRWLSNARMTHYQALLLDT
                        DRVQFGPVVALNPATLLPLPEEGLQHNCLDILAEAHGTRPDLTD
                        QPLPDADHTWYTDGSSLLQEGQRKAGAAVTTETEVIWAKALPA
                        GTSAQRAELIALTQALKMAEGKKLNVYTDSRYAFATAHIHGEIY
                        RRRGWLTSEGKEIKNKDEILALLKALFLPKRLSIIHCPGHQKGHS
                        AEARGNRMADQAARKAAITETPDTSTLLIENSSPSGGSKRTADG
                        SEFEPKKKRKV (SEQ ID NO: 163)

SPCAS9(H840A)-          MKRTADGSEFESPKKKRKVDKKYSIGLDIGTNSVGWAVITDEY
VRER-MALONEY            KVPSKKFKVLGNTDRHSIKKNLIGALLFDSGETAEATRLKRTAR
MURINE                  RRYTRRKNRICYLQEIFSNEMAKVDDSFFHRLEESFLVEEDKKH
LEUKEMIA VIRUS          ERHPIFGNIVDEVAYHEKYPTIYHLRKKLVDSTDKADLRLIYLAL
REVERSE                 AHMIKFRGHFLIEGDLNPDNSDVDKLFIQLVQTYNQLFEENPIN
TRANSCRIPTASE           ASGVDAKAILSARLSKSRRLENLIAQLPGEKKNGLFGNLIALSL
PRIME EDITOR            GLTPNFKSNFDLAEDAKLQLSKDTYDDDLDNLLAQIGDQYADL
                        FLAAKNLSDAILLSDILRVNTEITKAPLSASMIKRYDEHHQDLTL
                        LKALVRQQLPEKYKEIFFDQSKNGYAGYIDGGASQEEFYKFIKPI
                        LEKMDGTEELLVKLNREDLLRKQRTFDNGSIPHQIHLGELHAIL
                        RRQEDFYPFLKDNREKIEKILTFRIPYYVGPLARGNSRFAWMTR
                        KSEETITPWNFEEVVDKGASAQSFIERMTNFDKNLPNEKVLPKH
                        SLLYEYFTVYNELTKVKYVTEGMRKPAFLSGEQKKAIVDLLFKT
                        NRKVTVKQLKEDYFKKIECFDSVEISGVEDRFNASLGTYHDLL
                        KIIKDKDFLDNEENEDILEDIVLTLTLFEDREMIEERLKTYAHLFD
                        DKVMKQLKRRRYTGWGRLSRKLINGIRDKQSGKTILDFLKSDG
                        FANRNFMQLIHDDSLTFKEDIQKAQVSGQGDSLHEHIANLAGSP
                        AIKKGILQTVKVVDELVKVMGRHKPENIVIEMARENQTTQKGQ
                        KNSRERMKRIEEGIKELGSQILKEHPVENTQLQNEKLYLYYLQN
                        GRDMYVDQELDINRLSDYDVDAIVPQSFLKDDSIDNKVLTRSD
                        KNRGKSDNVPSEEVVKKMKNYWRQLLNAKLITQRKFDNLTKA
                        ERGGLSELDKAGFIKRQLVETRQITKHVAQILDSRMNTKYDEND
                        KLIREVKVITLKSKLVSDFRKDFQFYKVREINNYHHAHDAYLNA
                        VVGTALIKKYPKLESEFVYGDYKVYDVRKMIAKSEQEIGKATA
                        KYFFYSNIMNFFKTEITLANGEIRKRPLIETNGETGEIVWDKGRD
                        FATVRKVLSMPQVNIVKKTEVQTGGFSKESILPKRNSDKLIARK
                        KDWDPKKYGGFVSPTVAYSVLVVAKVEKGKSKKLKSVKELLGI
                        TIIVIERSSFEKNPIDFLEAKGYKEVKKDLIIKLPKYSLFELENGRK
                        RMLASARELQKGNELALPSKYVNFLYLASHYEKLKGSPEDNEQ
                        KQLFVEQHKHYLDEIIEQISEFSKRVILADANLDKVLSAYNKHR
                        DKPIREQAENIIHLFTLTNLGAPAAFKYFDTTIDRKEYRSTKEVL
                        DATLIHQSITGLYETRIDLSQLGGDSGGSSGGSSGSETPGTSESAT
                        PESSGGSSGGSSTLNIEDEYRLHETSKEPDVSLGSTWLSDFPQA
                        WAETGGMGLAVRQAPLIIPLKATSTPVSIKQYPMSQEARLGIKP
                        HIQRLLDQGILVPCQSPWNTPLLPVKKPGTNDYRPVQDLREVN
                        KRVEDIHPTVPNPYNLLSGLPPSHQWYTVLDLKDAFFCLRLHPT
                        SQPLFAFEWRDPEMGISGQLTWTRLPQGFKNSPTLFNEALHRDL
                        ADFRIQHPDLILLQYVDDLLLAATSELDCQQGTRALLQTLGNLG
                        YRASAKKAQICQKQVKYLGYLLKEGQRWLTEARKETVMGQPT
                        PKTPRQLREFLGKAGFCRLFIPGFAEMAAPLYPLTKPGTLFNWG
                        PDQQKAYQEIKQALLTAPALGLPDLTKPFELFVDEKQGYAKGVL
                        TQKLGPWRRPVAYLSKKLDPVAAGWPPCLRMVAAIAVLTKDAG
                        KLTMGQPLVILAPHAVEALVKQPPDRWLSNARMTHYQALLLDT
                        DRVQFGPVVALNPATLLPLPEEGLQHNCLDILAEAHGTRPDLTD
                        QPLPDADHTWYTDGSSLLQEGQRKAGAAVTTETEVIWAKALPA
                        GTSAQRAELIALTQALKMAEGKKLNVYTDSRYAFATAHIHGEIY
```

```
RRRGWLTSEGKEIKNKDEILALLKALFLPKRLSIIHCPGHQKGHS
AEARGNRMADQAARKAAITETPDTSTLLIENSSPSGGSKRTADG
SEFEPKKKRKV (SEQ ID NO: 164)
```

In yet other embodiments, the prime editor fusion proteins contemplated herein may include a Cas9 nickase (e.g., Cas9 (H840A)) fused to a truncated version of M-MLV reverse transcriptase. In this embodiment, the reverse transcriptase also contains 4 mutations (D200N, T306K, W313F, T330P; noting that the L603W mutation present in PE2 is no longer present due to the truncation). The DNA sequence encoding this truncated editor is 522 bp smaller than PE2, and therefore makes its potentially useful for applications where delivery of the DNA sequence is challenging due to its size (i.e. adeno-associated virus and lentivirus delivery). This embodiment is referred to as Cas9(H840A)-MMLV-RT (trunc) or "PE2-short" or "PE2-trunc" and has the following amino acid sequence:

| | |
|---|---|
| CAS9(H840A)-<br>MMLV-<br>RT(TRUNC) OR<br>PE2-SHORT | <u>MKRTADGSEFESPKKKRKV</u>DKKYSIGLDIGTNSVGWAVITDE<br>YKVPSKKFKVLGNTDRHSIKKNLIGALLFDSGETAEATRLK<br>RTARRRYTRRKNRICYLQEIFSNEMAKVDDSFFHRLEESFLV<br>EEDKKHERHPIFGNIVDEVAYHEKYPTIYHLRKKLVDSTDK<br>ADLRLIYLALAHMIKFRGHFLIEGDLNPDNSDVDKLFIQLVQ<br>TYNQLFEENPINASGVDAKAILSARLSKSRRLENLIAQLPGE<br>KKNGLFGNLIALSLGLTPNFKSNFDLAEDAKLQLSKDTYDD<br>DLDNLLAQIGDQYADLFLAAKNLSDAILLSDILRVNTEITKA<br>PLSASMIKRYDEHHQDLTLLKALVRQQLPEKYKEIFFDQSK<br>NGYAGYIDGGASQEEFYKFIKPILEKMDGTEELLVKLNRED<br>LLRKQRTFDNGSIPHQIHLGELHAILRRQEDFYPFLKDNREK<br>IEKILTFRIPYYVGPLARGNSRFAWMTRKSEETITPWNFEEV<br>VDKGASAQSFIERMTNFDKNLPNEKVLPKHSLLYEYFTVYN<br>ELTKVKYVTEGMRKPAFLSGEQKKAIVDLLFKTNRKVTVK<br>QLKEDYFKKIECFDSVEISGVEDRFNASLGTYHDLLKIIKDK<br>DFLDNEENEDILEDIVLTLTLFEDREMIEERLKTYAHLFDDK<br>VMKQLKRRRYTGWGRLSRKLINGIRDKQSGKTILDFLKSD<br>GFANRNFMQLIHDDSLTFKEDIQKAQVSGQGDSLHEHIANL<br>AGSPAIKKGILQTVKVVDELVKVMGRHKPENIVIEMARENQ<br>TTQKGQKNSRERMKRIEEGIKELGSQILKEHPVENTQLQNE<br>KLYLYYLQNGRDMYVDQELDINRLSDYDVDAIVPQSFLKDD<br>SIDNKVLTRSDKNRGKSDNVPSEEVVKKMKNYWRQLLNAK<br>LITQRKFDNLTKAERGGLSELDKAGFIKRQLVETRQITKHV<br>AQILDSRMNTKYDENDKLIREVKVITLKSKLVSDFRKDFQF<br>YKVREINNYHHAHDAYLNAVVGTALIKKYPKLESEFVYGDY<br>KVYDVRKMIAKSEQEIGKATAKYFFYSNIMNFFKTEITLAN<br>GEIRKRPLIETNGETGEIVWDKGRDFATVRKVLSMPQVNIV<br>KKTEVQTGGFSKESILPKRNSDKLIARKKDWDPKKYGGFDS<br>PTVAYSVLVVAKVEKGKSKKLKSVKELLGITIMERSSFEKN<br>PIDFLEAKGYKEVKKDLIIKLPKYSLFELENGRKRMLASAG<br>ELQKGNELALPSKYVNFLYLASHYEKLKGSPEDNEQKQLFV<br>EQHKHYLDEIIEQISEFSKRVILADANLDKVLSAYNKHRDKP<br>IREQAENIIHLFTLTNLGAPAAFKYFDTTIDRKRYTSTKEVL<br>DATLIHQSITGLYETRIDLSQLGGD<u>SGGSSGGSSGSETPGTSE</u><br><u>SATPESSGGSSGGSS</u>*TLNIEDEYRLHETSKEPDVSLGSTWLSDFPQ*<br>*AWAETGGMGLAVRQAPLIIPLKATSTPVSIKQYPMSQEARLGIKPHI*<br>*QRLLDQGILVPCQSPWNTPLLPVKKPGTNDYRPVQDLREVNKRVE*<br>*DIHPTVPNPYNLLSGLPPSHQWYTVLDLKDAFFCLRLHPTSQPLFA*<br>*FEWRDPEMGISGQLTWTRLPQGFKNSPTLFNEALHRDLADFRIQH*<br>*PDLILLQYVDDLLLAATSELDCQQGTRALLQTLGNLGYRASAKKAQI*<br>*CQKQVKYLGYLLKEGQRWLTEARKETVMGQPTPKTPRQLREFLGK*<br>*AGFCRLFIPGFAEMAAPLYPLTKPGTLFNWGPDQQKAYQEIKQAL*<br>*LTAPALGLPDLTKPFELFVDEKQGYAKGVLTQKLGPWRRPVAYLSK*<br>*KLDPVAAGWPPCLRMVAAIAVLTKDAGKLTMGQPLVILAPHAVEA*<br>*LVKQPPDRWLSNARMTHYQALLLDTDRVQFGPVVALNPATLLPLP*<br>*EEGLQHNCLDNSRLIN*<u>SGGSKRTADGSEFEPKKKRKV</u> (SEQ ID<br>NO: 765)<br>KEY:<br><u>NUCLEAR LOCALIZATION SEQUENCE (NLS)</u> TOP:(SEQ ID NO:<br>124), BOTTOM: (SEQ ID NO: 133)<br>CAS9(H840A) (SEQ ID NO: 157)<br>33-AMINO ACID LINKER 1 (SEQ ID NO: 127)<br>*M-MLV TRUNCATED REVERSE TRANSCRIPTASE* (SEQ ID NO:<br>766) |

See FIG. 75, which provides a bar graph comparing the efficiency (i.e., "% of total sequencing reads with the specified edit or indels") of PE2, PE2-trunc, PE3, and PE3-trunc over different target sites in various cell lines. The data shows that the prime editors comprising the truncated RT variants were about as efficient as the prime editors comprising the non-truncated RT proteins.

In various embodiments, the prime editor fusion proteins contemplated herein may also include any variants of the above-disclosed sequences having an amino acid sequence that is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to PE1, PE2, or any of the above indicated prime editor fusion sequences.

In certain embodiments, linkers may be used to link any of the peptides or peptide domains or moieties of the invention (e.g., a napDNAbp linked or fused to a reverse transcriptase).

[5] Linkers and Other Domains

The PE fusion proteins may comprise various other domains besides the napDNAbp (e.g., Cas9 domain) and the polymerase domain (e.g., RT domain). For example, in the case where the napDNAbp is a Cas9 and the polymerase is a RT, the PE fusion proteins may comprise one or more linkers that join the Cas9 domain with the RT domain. The linkers may also join other functional domains, such as nuclear localization sequences (NLS) or a FEN1 (or other flap endonuclease) to the PE fusion proteins or a domain thereof.

In addition, in embodiments involving trans prime editing, linkers may be used to link tPERT recruitment protein to a prime editor, e.g., between the tPERt recruitment protein and the napDNAbp. See e.g., FIG. 3G for an exemplary schematic of a trans prime editor (tPE) that includes linkers to separately fuse a polymerase domain and a recruiting protein domain to a napDNAbp.

A. Linkers

As defined above, the term "linker," as used herein, refers to a chemical group or a molecule linking two molecules or moieties, e.g., a binding domain and a cleavage domain of a nuclease. In some embodiments, a linker joins a gRNA binding domain of an RNA-programmable nuclease and the catalytic domain of a polymerase (e.g., a reverse transcriptase). In some embodiments, a linker joins a dCas9 and reverse transcriptase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some other embodiments, the linker comprises the amino acid sequence $(GGGGS)_n$ (SEQ ID NO: 165), $(G)_n$ (SEQ ID NO: 166), $(EAAAK)_n$ (SEQ ID NO: 167), $(GGS)_n$ (SEQ ID NO: 168), $(SGGS)_n$ (SEQ ID NO: 169), $(XP)_n$ (SEQ ID NO: 170), or any combination thereof, wherein n is independently an integer between 1 and 30, and wherein X is any amino acid. In some embodiments, the linker comprises the amino acid sequence (GGS)N(SEQ ID NO: 176), wherein n is 1, 3, or 7. In some embodiments, the linker comprises the amino acid sequence SGSETPGTSESATPES (SEQ ID NO: 171). In some embodiments, the linker comprises the amino acid sequence SGGSSGGSSGSETPGTSESATPESSGGSSGGS (SEQ ID NO: 172). In some embodiments, the linker comprises the amino acid sequence SGGSGGSGGS (SEQ ID NO: 173). In some embodiments, the linker comprises the amino acid sequence SGGS (SEQ ID NO: 174). In other embodiments, the linker comprises the amino acid sequence

```
                              (SEQ ID NO: 175, 60AA)
SGGSSGGSSGSETPGTSESATPESAGSYPYDVPDYAGSAAPAAKKKKLD
GSGSGGSSGGS.
```

In certain embodiments, linkers may be used to link any of the peptides or peptide domains or moieties of the invention (e.g., a napDNAbp linked or fused to a reverse transcriptase).

As defined above, the term "linker," as used herein, refers to a chemical group or a molecule linking two molecules or moieties, e.g., a binding domain and a cleavage domain of a nuclease. In some embodiments, a linker joins a gRNA binding domain of an RNA-programmable nuclease and the catalytic domain of a recombinase. In some embodiments, a linker joins a dCas9 and reverse transcriptase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminoHEXAnoic acid (Ahx). In certain embodiments, the linker is based on a carbocyclic moiety (e.g., cyclopentane, cycloHEXAne). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some other embodiments, the linker comprises the amino acid sequence (GGGGS)n (SEQ ID NO: 165), (G)n (SEQ ID NO: 166), (EAAAK)$_n$ (SEQ ID NO: 167), (GGS)$_n$ (SEQ ID NO: 168), (SGGS)n (SEQ ID NO: 169), (XP)n (SEQ ID NO: 170), or any combination thereof, wherein n is independently an integer between 1 and 30, and wherein X is any amino acid. In some embodiments, the linker comprises the amino acid sequence (GGS)N(SEQ ID NO: 176), wherein n is 1, 3, or 7. In some embodiments, the linker comprises the amino acid sequence SGSETPGTSESATPES (SEQ ID NO: 171). In some embodiments, the linker comprises the amino acid sequence SGGSSGGSSGSETPGTSESATPESSGGSSGGS (SEQ ID NO: 172). In some embodiments, the linker comprises the amino acid sequence SGGSGGSGGS (SEQ ID NO: 173). In some embodiments, the linker comprises the amino acid sequence SGGS (SEQ ID NO: 174).

In particular, the following linkers can be used in various embodiments to join prime editor domains with one another:

GGS;  (SEQ ID NO: 767)

GGSGGS;  (SEQ ID NO: 768)

GGSGGSGGS;  (SEQ ID NO: 769)

SGGSSGGSSGSETPGTSESATPESSGGSSGGSS;  (SEQ ID NO: 127)

SGSETPGTSESATPES;  (SEQ ID NO: 171)

SGGSSGGSSGSETPGTSESATPESAGSYPYDVPDYAGSAAPAAKKKKLD GSGSGGSSGGS.  (SEQ ID NO: 175)

B. Nuclear Localization Sequence (NLS)

In various embodiments, the PE fusion proteins may comprise one or more nuclear localization sequences (NLS), which help promote translocation of a protein into the cell nucleus. Such sequences are well-known in the art and can include the following examples:

| DESCRIPTION | SEQUENCE | SEQ ID NO: |
|---|---|---|
| NLS OF SV40 LARGE T-AG | PKKKRKV | SEQ ID NO: 16 |
| NLS | MKRTADGSEFESPKKKRKV | SEQ ID NO: 124 |
| NLS | MDSLLMNRRKFLYQFKNVRWAKGRRETYLC | SEQ ID NO: 17 |
| NLS OF NUCLEOPLASMIN | AVKRPAATKKAGQAKKKKLD | SEQ ID NO: 190 |
| NLS OF EGL-13 | MSRRRKANPTKLSENAKKLAKEVEN | SEQ ID NO: 191 |
| NLS OF C-MYC | PAAKRVKLD | SEQ ID NO: 192 |
| NLS OF TUS-PROTEIN | KLKIKRPVK | SEQ ID NO: 193 |
| NLS OF POLYOMA LARGE T-AG | VSRKRPRP | SEQ ID NO: 194 |
| NLS OF HEPATITIS D VIRUS ANTIGEN | EGAPPAKRAR | SEQ ID NO: 195 |
| NLS OF MURINE P53 | PPQPKKKPLDGE | SEQ ID NO: 196 |
| NLS OF PE1 AND PE2 | SGGSKRTADGSEFEPKKKRKV | SEQ ID NO: 133 |

The NLS examples above are non-limiting. The PE fusion proteins may comprise any known NLS sequence, including any of those described in Cokol et al., "Finding nuclear localization signals," *EMBO Rep.*, 2000, 1(5): 411-415 and Freitas et al., "Mechanisms and Signals for the Nuclear Import of Proteins," *Current Genomics*, 2009, 10(8): 550-7, each of which are incorporated herein by reference.

In various embodiments, the prime editors and constructs encoding the prime editors disclosed herein further comprise one or more, preferably, at least two nuclear localization signals. In certain embodiments, the prime editors comprise at least two NLSs. In embodiments with at least two NLSs, the NLSs can be the same NLSs or they can be different NLSs. In addition, the NLSs may be expressed as part of a fusion protein with the remaining portions of the prime editors. In some embodiments, one or more of the NLSs are bipartite NLSs ("bpNLS"). In certain embodiments, the disclosed fusion proteins comprise two bipartite NLSs. In some embodiments, the disclosed fusion proteins comprise more than two bipartite NLSs.

The location of the NLS fusion can be at the N-terminus, the C-terminus, or within a sequence of a prime editor (e.g., inserted between the encoded napDNAbp component (e.g., Cas9) and a polymerase domain (e.g., a reverse transcriptase domain).

The NLSs may be any known NLS sequence in the art. The NLSs may also be any future-discovered NLSs for nuclear localization. The NLSs also may be any naturally-occurring NLS, or any non-naturally occurring NLS (e.g., an NLS with one or more desired mutations).

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., International PCT application PCT/EP2000/011690, filed Nov. 23, 2000, published as WO/2001/038547 on May 31, 2001, the contents of which are incorporated herein by reference. In some embodiments, an NLS comprises the amino acid sequence PKKKRKV (SEQ ID NO: 16), MDSLLMNRRKFLY-QFKNVRWAKGRRETYLC (SEQ ID NO: 17), KRTADGSEFESPKKKRKV (SEQ ID NO: 3864), or KRTADGSEFEPKKKRKV (SEQ ID NO: 125). In other embodiments, NLS comprises the amino acid sequences NLSKRPAAIKKAGQAKKKK (SEQ ID NO: 136), PAAKRVKLD (SEQ ID NO: 192), RQRRNELKRSF (SEQ ID NO: 3934), NQSSNFGPMKGGNFG-GRSSGPYGGGGQYFAKPRNQGGY (SEQ ID NO: 3935).

In one aspect of the disclosure, a prime editor may be modified with one or more nuclear localization signals (NLS), preferably at least two NLSs. In certain embodiments, the prime editors are modified with two or more NLSs. The disclosure contemplates the use of any nuclear localization signal known in the art at the time of the disclosure, or any nuclear localization signal that is identified or otherwise made available in the state of the art after the time of the instant filing. A representative nuclear localization signal is a peptide sequence that directs the protein to the nucleus of the cell in which the sequence is expressed. A nuclear localization signal is predominantly basic, can be positioned almost anywhere in a protein's amino acid sequence, generally comprises a short sequence of four amino acids (Autieri & Agrawal, (1998) J. Biol. Chem. 273: 14731-37, incorporated herein by reference) to eight amino acids, and is typically rich in lysine and arginine residues (Magin et al., (2000) Virology 274: 11-16, incorporated herein by reference). Nuclear localization signals often comprise proline residues. A variety of nuclear localization signals have been identified and have been used to effect transport of biological molecules from the cytoplasm to the nucleus of a cell. See, e.g., Tinland et al., (1992) Proc. Natl. Acad. Sci. U.S.A. 89:7442-46; Moede et al., (1999) FEBS Lett. 461:229-34, which is incorporated by reference. Translocation is currently thought to involve nuclear pore proteins.

Most NLSs can be classified in three general groups: (i) a monopartite NLS exemplified by the SV40 large T antigen NLS (PKKKRKV (SEQ ID NO: 16)); (ii) a bipartite motif consisting of two basic domains separated by a variable number of spacer amino acids and exemplified by the Xenopus nucleoplasmin NLS (KRXXXXXXXXXXKKKL (SEQ ID NO: 3936)); and (iii) noncanonical sequences such as M9 of the hnRNP A1 protein, the influenza virus nucleoprotein NLS, and the yeast Gal4 protein NLS (Dingwall and Laskey 1991).

Nuclear localization signals appear at various points in the amino acid sequences of proteins. NLS's have been identified at the N-terminus, the C-terminus and in the central region of proteins. Thus, the disclosure provides prime editors that may be modified with one or more NLSs at the C-terminus, the N-terminus, as well as at in internal region of the prime editor. The residues of a longer sequence that do not function as component NLS residues should be selected so as not to interfere, for example tonically or sterically, with the nuclear localization signal itself. Therefore, although there are no strict limits on the composition of an NLS-comprising sequence, in practice, such a sequence can be functionally limited in length and composition.

The present disclosure contemplates any suitable means by which to modify a prime editor to include one or more NLSs. In one aspect, the prime editors may be engineered to express a prime editor protein that is translationally fused at its N-terminus or its C-terminus (or both) to one or more NLSs, i.e., to form a prime editor-NLS fusion construct. In other embodiments, the prime editor-encoding nucleotide sequence may be genetically modified to incorporate a reading frame that encodes one or more NLSs in an internal region of the encoded prime editor. In addition, the NLSs may include various amino acid linkers or spacer regions encoded between the prime editor and the N-terminally, C-terminally, or internally-attached NLS amino acid sequence, e.g, and in the central region of proteins. Thus, the present disclosure also provides for nucleotide constructs, vectors, and host cells for expressing fusion proteins that comprise a prime editor and one or more NLSs.

The prime editors described herein may also comprise nuclear localization signals which are linked to a prime editor through one or more linkers, e.g., and polymeric, amino acid, nucleic acid, polysaccharide, chemical, or nucleic acid linker element. The linkers within the contemplated scope of the disclosure are not intented to have any limitations and can be any suitable type of molecule (e.g., polymer, amino acid, polysaccharide, nucleic acid, lipid, or any synthetic chemical linker domain) and be joined to the prime editor by any suitable strategy that effectuates forming a bond (e.g., covalent linkage, hydrogen bonding) between the prime editor and the one or more NLS s.

C. Flap Endonucleases (e.g., FEN1)

In various embodiments, the PE fusion proteins may comprise one or more flap endonulceases (e.g., FEN1), which refers to an enzyme that catalyzes the removal of 5' single strand DNA flaps. These are naturally occurring enzymes that process the removal of 5' flaps formed during cellular processes, including DNA replication. The prime editing methods herein described may utilize endogenously supplied flap endonucleases or those provided in trans to remove the 5' flap of endogenous DNA formed at the target site during prime editing. Flap endonucleases are known in the art and can be found described in Patel et al., "Flap endonucleases pass 5'-flaps through a flexible arch using a disorder-thread-order mechanism to confer specificity for free 5'-ends," Nucleic Acids Research, 2012, 40(10): 4507-4519 and Tsutakawa et al., "Human flap endonuclease structures, DNA double-base flipping, and a unified understanding of the FEN1 superfamily," Cell, 2011, 145(2): 198-211 (each of which are incorporated herein by reference). An exemplary flap endonuclease is FEN1, which can be represented by the following amino acid sequence:

| Description | Sequence | SEQ ID NO: |
|---|---|---|
| FEN1 Wild type (wt) | MGIQGLAKLIADVAPSAIRENDIKSYFGRKVAIDASMSI YQFLIAVRQGGDVLQNEEGETTSHLMGMFYRTIRMMENG IKPVYVFDGKPPQLKSGELAKRSERRAEAEKQLQQAQAA GAEQEVEKFTKRLVKVTKQHNDECKHLLSLMGIPYLDAP SEAEASCAALVKAGKVYAAATEDMDCLTFGSPVLMRHLT ASEAKKLPIQEFHLSRILQELGLNQEQFVDLCILLGSDY CESIRGIGPKRAVDLIQKHKSIEEIVRRLDPNKYPVPEN WLHKEAHQLFLEPEVLDPESVELKWSEPNEEELIKFMCG EKQFSEERIRSGVKRLSKSRQGSTQGRLDDFFKVTGSLS SAKRKEPEPKGSTKKKAKTGAAGKFKRGK | SEQ ID NO: 198 |

The flap endonucleases may also include any FEN1 variant, mutant, or other flap endonuclease ortholog, homolog, or variant. Non-limiting FEN1 variant examples are as follows:

| Description | Sequence | SEQ ID NO: |
|---|---|---|
| FEN1 K168R (relative to FEN1 wt) | MGIQGLAKLIADVAPSAIRENDIKSYFGRKVAIDASMSI YQFLIAVRQGGDVLQNEEGETTSHLMGMFYRTIRMMENG IKPVYVFDGKPPQLKSGELAKRSERRAEAEKQLQQAQAA GAEQEVEKFTKRLVKVTKQHNDECKHLLSLMGIPYLDAP SEAEASCAALVRAGKVYAAATEDMDCLTFGSPVLMRHLT ASEAKKLPIQEFHLSRILQELGLNQEQFVDLCILLGSDY CESIRGIGPKRAVDLIQKHKSIEEIVRRLDPNKYPVPEN WLHKEAHQLFLEPEVLDPESVELKWSEPNEEELIKFMCG EKQFSEERIRSGVKRLSKSRQGSTQGRLDDFFKVTGSLS SAKRKEPEPKGSTKKKAKTGAAGKFKRGK | SEQ ID NO: 199 |
| FEN1 S187A (relative to FEN1 wt) | MGIQGLAKLIADVAPSAIRENDIKSYFGRKVAIDASMSI YQFLIAVRQGGDVLQNEEGETTSHLMGMFYRTIRMMENG IKPVYVFDGKPPQLKSGELAKRSERRAEAEKQLQQAQAA GAEQEVEKFTKRLVKVTKQHNDECKHLLSLMGIPYLDAP SEAEASCAALVKAGKVYAAATEDMDCLTFGAPVLMRHLT ASEAKKLPIQEFHLSRILQELGLNQEQFVDLCILLGSDY CESIRGIGPKRAVDLIQKHKSIEEIVRRLDPNKYPVPEN WLHKEAHQLFLEPEVLDPESVELKWSEPNEEELIKFMCG EKQFSEERIRSGVKRLSKSRQGSTQGRLDDFFKVTGSLS SAKRKEPEPKGSTKKKAKTGAAGKFKRGK | SEQ ID NO: 200 |
| FEN1 K354R (relative to FEN1 wt) | MGIQGLAKLIADVAPSAIRENDIKSYFGRKVAIDASMSI YQFLIAVRQGGDVLQNEEGETTSHLMGMFYRTIRMMENG IKPVYVFDGKPPQLKSGELAKRSERRAEAEKQLQQAQAA GAEQEVEKFTKRLVKVTKQHNDECKHLLSLMGIPYLDAP SEAEASCAALVKAGKVYAAATEDMDCLTFGSPVLMRHLT ASEAKKLPIQEFHLSRILQELGLNQEQFVDLCILLGSDY CESIRGIGPKRAVDLIQKHKSIEEIVRRLDPNKYPVPEN WLHKEAHQLFLEPEVLDPESVELKWSEPNEEELIKFMCG EKQFSEERIRSGVKRLSKSRQGSTQGRLDDFFKVTGSLS SARRKEPEPKGSTKKKAKTGAAGKFKRGK | SEQ ID NO: 201 |
| GEN1 | MGVNDLWQILEPVKQHIPLRNLGGKTIAVDLSLWVCEAQ TVKKMMGSVMKPHLRNLFFRISYLTQMDVKLVFVMEGEP PKLKADVISKRNQSRYGSSGKSWSQKTGRSHFKSVLREC LHMLECLGIPWVQAAGEAEAMCAYLNAGGHVDGCLTNDG DTFLYGAQTVYRNFTMNTKDPHVDCYTMSSIKSKLGLDR DALVGLAILLGCDYLPKGVPGVGKEQALKLIQILKGQSL LQRFNRWNETSCNSSPQLLVTKKLA HCSVCSHPGSPKDHERNGCRLCKSDKYCEPHDYEYCC PCEWHRTEHDRQLSEVENNIKKKACCCEGFPPFHEVIQ EFLLNKDKLVKVIRYQRPDLLLFQRFTLEKMEWPNHY ACEKLLVLLTHYDMIERKLGSRNSNQLQPIRIVKTRI RNGVHCFEIEWEKPEHYAMEDKQHGEFALLTIEEESL FEAAYPEIVAVYQKQKLEIKGKKQKRIKPKENNLPEPDEVM SFQSHMTLKPTCEIPHKQNSKLNSGISPDPTLPQESISAS LNSLLLPKNTPCLNAQEQFMSSLRPLAIQQIKAVSKSLI SESSQPNTSSHNISVIADLHLSTIDWEGTSFSNSPAIQRN TFSHDLKSEVESELSAIPDGFENIPEQLSCESERYTANIK KVLDEDSDGISPEEHLLSGITDLCLQDLPLKERIFTKLSY PQDNLQPDVNLKTLSILSVKESCIANSGSDCTSHLSKDL PGIPLQNESRDSKILKGDQLLQEDYKVNTSVPYSVSNT VVKTCNVRPPNTALDHSRKVDMQTTRKILMKKSVCLD RHSSDEQSAPVFGKAKYTTQRMKHSSQKHNSSHFKES GHNKLSSPKIHIKETEQCVRSYETAENEESCFPDSTKSS LSSLQCHKKENNSGTCLDSPLPLRQRLKLRFQST | SEQ ID NO: 202 |

| Description | Sequence | SEQ ID NO: |
|---|---|---|
| ERCC5 | MGVQGLWKLLECSGRQVSPEALEGKILAVDISIWLNQ ALKGVRDRHGNSIENPHLLTLFHRLCKLLFFRIRPIFVF DGDAPLLKKQTLVKRRQRKDLASSDSRKTTEKLLKTF LKRQAIKTAFRSKRDEALPSLTQVRRENDLYVLPPLQE EEKHSSEEEDEKEWQERMNQKQALQEEFFHNPQAIDIE SEDFSSLPPEVKHEILTDMKEFTKRRRTLFEAMPEESDD FSQYQLKGLLKKNYLNQHIEHVQKEMNQQHSGHIRRQ YEDEGGFLKEVESRRVVSEDTSHYILIKGIQAKTVAEV DSESLPSSSKMHGMSFDVKSSPCEKLKTEKEPDATPPSP RTLLAMQAALLGSSSEEELESENRRQARGRNAPAAVD EGSISPRTLSAIKRALDDDEDVKVCAGDDVQTGGPGAE EMRINSSTENSDEGLKVRDGKGIPFTATLASSSVNSAEE HVASTNEGREPTDSVPKEQMSLVHVGTEAFPISDESMI KDRKDRLPLESAVVRHSDAPGLPNGRELTPASPTCTNS VSKNETHAEVLEQQNELCPYESKFDSSLLSSDDETKCK PNSASEVIGPVSLQETSSIVSVPSEAVDNVENVVSFNAK EHENFLETIQEQQTTESAGQDLISIPKAVEPMEIDSEESE SDGSFIEVQSVISDEELQAEFPETSKPPSEQGEEELVGTR EGEAPAESESLLRDNSERDDVDGEPQEAEKDAEDSLHE WQDINLEELETLESNLLAQQNSLKAQKQQQERIAATVT GQMFLESQELLRLFGIPYIQAPMEAEAQCAILDLTDQTS GTITDDSDIWLFGARHVYRNFFNKNKFVEYYQYVDFH NQLGLDRNKLINLAYLLGSDYTEGIPTVGCVTAMEILN EFPGHGLEPLLKFSEWWHEAQKNPKIRPNPHDTKVKK KLRTLQLTPGFPNPAVAEAYLKPVVDDSKGSFLWGKP DLDKIREFCQRYFGWNRTKTDESLFPVLKQLDAQQTQ LRIDSFFRLAQQEKEDAKRIKSQRLNRAVTCMLRKEKE AAASEIEAVSVAMEKEFELLDKAKRKTQKRGITNTLEE SSSLKRKRLSDSKRKNTCGGFLGETCLSESSDGSSSEDA ESSSLMNVQRRTAAKEPKTSASDSQNSVKEAPVKNGG ATTSSSSDSDDDGGKEKMVLVTARSVFGKKRRKLRRA RGRKRKT | SEQ ID NO: 203 |

In various embodiments, the prime editor fusion proteins contemplated herein may include any flap endonuclease variant of the above-disclosed sequences having an amino acid sequence that is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any of the above sequences.

Other endonucleases that may be utilized by the instant methods to facilitate removal of the 5' end single strand DNA flap include, but are not limited to (1) trex 2, (2) exo1 endonuclease (e.g., Keijzers et al., *Biosci Rep.* 2015, 35(3): e00206)

Trex 2

3' Three Prime Repair Exonuclease 2 (TREX2)—Human Accession No. NM_080701

(SEQ ID NO: 3865)
MSEAPRAETFVFLDLEATGLPSVEPEIAELSLFAVHRSSLENPEHDESGA

LVLPRVLDKLTLCMCPERPFTAKASEITGLSSEGLARCRKAGFDGAVVR

TLQAFLSRQAGPICLVAHNGFDYDFPLLCAELRRLGARLPRDTVCLDTLP

ALRGLDRAHSHGTRARGRQGYSLGSLFHRYFRAEPSAAHSAEGDVHTLLL

IFLHRAAELLAWADEQARGWAHIEPMYLPPDDPSLEA.

3' Three Prime Repair Exonuclease 2 (TREX2)—Mouse Accession No. NM_011907

(SEQ ID NO: 3866)
MSEPPRAETFVFLDLEATGLPNMDPEIAEISLFAVHRSSLENPERDDSGS

LVLPRVLDKLTLCMCPERPFTAKASEITGLSSESLMHCGKAGFNGAVVRT

LQGFLSRQEGPICLVAHNGFDYDFPLLCTELQRLGAHLPQDTVCLDTLPA

LRGLDRAHSHGTRAQGRKSYSLASLFHRYFQAEPSAAHSAEGDVHTLLLI

FLHRAPELLAWADEQARSWAHIEPMYVPPDGPSLEA.

3' Three Prime Repair Exonuclease 2 (TREX2)—Rat Accession No. NM_001107580

(SEQ ID NO: 3867)
MSEPLRAETFVFLDLEATGLPNMDPEIAEISLFAVHRSSLENPERDDSG

SLVLPRVLDKLTLCMCPERPFTAKASEITGLSSEGLMNCRKAAFNDAVV

RTLQGFLSRQEGPICLVAHNGFDYDFPLLCTELQRLGAHLPRDTVCLDT

LPALRGLDRVHSHGTRAQGRKSYSLASLFHRYFQAEPSAAHSAEGDVNT

LLLIFLHRAPELLAWADEQARSWAHIEPMYVPPDGPSLEA.

ExoI

Human exonuclease 1 (EXO1) has been implicated in many different DNA metabolic processes, including DNA mismatch repair (MMR), micro-mediated end-joining, homologous recombination (HR), and replication. Human EXO1 belongs to a family of eukaryotic nucleases, Rad2/XPG, which also include FEN1 and GEN1. The Rad2/XPG family is conserved in the nuclease domain through species from phage to human. The EXO1 gene product exhibits both 5' exonuclease and 5' flap activity. Additionally, EXO1 contains an intrinsic 5' RNase H activity. Human EXO1 has a high affinity for processing double stranded DNA (dsDNA), nicks, gaps, pseudo Y structures and can resolve Holliday junctions using its inherit flap activity. Human EXO1 is implicated in MMR and contain conserved binding domains interacting directly with MLH1 and MSH2. EXO1 nucleolytic activity is positively stimulated by PCNA, MutSα (MSH2/MSH6 complex), 14-3-3, MRN and 9-1-1 complex.

Exonuclease 1 (EXO1) Accession No. NM_003686 (*Homo sapiens* Exonuclease 1 (EXO1), Transcript Variant 3)—Isoform A (SEQ ID NO: 3868)
MGIQGLLQFIKEASEPIHVRKYKGQVVAVDTYCWLHKGAIACAEKLAKG

EPTDRYVGFCMKFVNMLLSHGIKPILVFDGCTLPSKKEVERSRRERRQA

NLLKGKQLLREGKVSEARECFTRSINITHAMAHKVIKAARSQGVDCLVA

PYEADAQLAYLNKAGIVQAIITEDSDLLAFGCKKVILKMDQFGNGLEID

QARLGMCRQLGDVFTEEKFRYMCILSGCDYLSSLRGIGLAKACKVLRLA

NNPDIVKVIKKIGHYLKMNITVPEDYINGFIRANNTFLYQLVFDPIKRK

LIPLNAYEDDVDPETLSYAGQYVDDSIALQIALGNKDINTFEQIDDYNP

DTAMPAHSRSHSWDDKTCQKSANVSSIWHRNYSPRPESGTVSDAPQLKE

NPSTVGVERVISTKGLNLPRKSSIVKRPRSAELSEDDLLSQYSLSFTKK

TKKNSSEGNKSLSFSEVFVPDLVNGPTNKKSVSTPPRTRNKFATFLQRK

NEESGAVVVPGTRSRFFCSSDSTDCVSNKVSIQPLDETAVTDKENNLHE

SEYGDQEGKRLVDTDVARNSSDDIPNNHIPGDHIPDKATVFTDEESYSF

ESSKFTRTISPPTLGTLRSCFSWSGGLGDFSRTPSPSPSTALQQFRRKS

DSPTSLPENNMSDVSQLKSEESSDDESHPLREEACSSQSQESGEFSLQS

SNASKLSQCSSKDSDSEESDCNIKLLDSQSDQTSKLRLSHFSKKDTPLR

NKVPGLYKSSSADSLSTTKIKPLGPARASGLSKKPASIQKRKHHNAENK

PGLQIKLNELWKNFGFKKF.

Exonuclease 1 (EXO1) Accession No. NM_006027 (*Homo sapiens* Exonuclease 1 (EXO1), Transcript Variant 3)—Isoform B (SEQ ID NO: 3869)
MGIQGLLQFIKEASEPIHVRKYKGQVVAVDTYCWLHKGAIACAEKLAKG

EPTDRYVGFCMKFVNMLLSHGIKPILVFDGCTLPSKKEVERSRRERRQA

NLLKGKQLLREGKVSEARECFTRSINITHAMAHKVIKAARSQGVDCLVA

PYEADAQLAYLNKAGIVQAIITEDSDLLAFGCKKVILKMDQFGNGLEID

QARLGMCRQLGDVFTEEKFRYMCILSGCDYLSSLRGIGLAKACKVLRLA

NNPDIVKVIKKIGHYLKMNITVPEDYINGFIRANNTFLYQLVFDPIKRK

LIPLNAYEDDVDPETLSYAGQYVDDSIALQIALGNKDINTFEQIDDYNP

DTAMPAHSRSHSWDDKTCQKSANVSSIWHRNYSPRPESGTVSDAPQLKE

NPSTVGVERVISTKGLNLPRKSSIVKRPRSAELSEDDLLSQYSLSFTKK

TKKNSSEGNKSLSFSEVFVPDLVNGPTNKKSVSTPPRTRNKFATFLQRK

NEESGAVVVPGTRSRFFCSSDSTDCVSNKVSIQPLDETAVTDKENNLHE

SEYGDQEGKRLVDTDVARNSSDDIPNNHIPGDHIPDKATVFTDEESYSF

ESSKFTRTISPPTLGTLRSCFSWSGGLGDFSRTPSPSPSTALQQFRRKS

DSPTSLPENNMSDVSQLKSEESSDDESHPLREEACSSQSQESGEFSLQS

SNASKLSQCSSKDSDSEESDCNIKLLDSQSDQTSKLRLSHFSKKDTPLR

NKVPGLYKSSSADSLSTTKIKPLGPARASGLSKKPASIQKRKHHNAENK

PGLQIKLNELWKNFGFKKDSEKLPPCKKPLSPVRDNIQLTPEAEEDIFN

KPECGRVQRAIFQ.

Exonuclease 1 (EXO1) Accession No. NM_001319224 (*Homo sapiens* Exonuclease 1 (EXO1), Transcript Variant 4)—Isoform C (SEQ ID NO: 3870)
MGIQGLLQFIKEASEPIHVRKYKGQVVAVDTYCWLHKGAIACAEKLAKG

EPTDRYVGFCMKFVNMLLSHGIKPILVFDGCTLPSKKEVERSRRERRQA

NLLKGKQLLREGKVSEARECFTRSINITHAMAHKVIKAARSQGVDCLVA

PYEADAQLAYLNKAGIVQAIITEDSDLLAFGCKKVILKMDQFGNGLEID

QARLGMCRQLGDVFTEEKFRYMCILSGCDYLSSLRGIGLAKACKVLRLA

NNPDIVKVIKKIGHYLKMNITVPEDYINGFIRANNTFLYQLVFDPIKRK

LIPLNAYEDDVDPETLSYAGQYVDDSIALQIALGNKDINTFEQIDDYNP

DTAMPAHSRSHSWDDKTCQKSANVSSIWHRNYSPRPESGTVSDAPQLKE

NPSTVGVERVISTKGLNLPRKSSIVKRPRSELSEDDLLSQYSLSFTKKT

KKNSSEGNKSLSFSEVFVPDLVNGPTNKKSVSTPPRTRNKFATFLQRKN

EESGAVVVPGTRSRFFCSSDSTDCVSNKVSIQPLDETAVTDKENNLHES

EYGDQEGKRLVDTDVARNSSDDIPNNHIPGDHIPDKATVFTDEESYSFE

SSKFTRTISPPTLGTLRSCFSWSGGLGDFSRTPSPSPSTALQQFRRKSD

SPTSLPENNMSDVSQLKSEESSDDESHPLREEACSSQSQESGEFSLQSS

NASKLSQCSSKDSDSEESDCNIKLLDSQSDQTSKLRLSHFSKKDTPLRN

KVPGLYKSSSADSLSTTKIKPLGPARASGLSKKPASIQKRKHHNAENKP

GLQIKLNELWKNFGFKKDSEKLPPCKKPLSPVRDNIQLTPEAEEDIFNK

PECGRVQRAIFQ.

D. Inteins and Split-Inteins

It will be understood that in some embodiments (e.g., delivery of a prime editor in vivo using AAV particles), it may be advantageous to split a polypeptide (e.g., a deaminase or a napDNAbp) or a fusion protein (e.g., a prime editor) into an N-terminal half and a C-terminal half, delivery them separately, and then allow their colocalization to reform the complete protein (or fusion protein as the case may be) within the cell. Separate halves of a protein or a fusion protein may each comprise a split-intein tag to facilitate the reformation of the complete protein or fusion protein by the mechanism of protein trans splicing.

Protein trans-splicing, catalyzed by split inteins, provides an entirely enzymatic method for protein ligation. A split-intein is essentially a contiguous intein (e.g. a mini-intein) split into two pieces named N-intein and C-intein, respectively. The N-intein and C-intein of a split intein can associate non-covalently to form an active intein and catalyze the splicing reaction essentially in same way as a contiguous intein does. Split inteins have been found in nature and also engineered in laboratories. As used herein, the term "split intein" refers to any intein in which one or more peptide bond breaks exists between the N-terminal and C-terminal amino acid sequences such that the N-terminal and C-terminal sequences become separate molecules that can non-covalently reassociate, or reconstitute, into an intein that is functional for trans-splicing reactions. Any catalytically active intein, or fragment thereof, may be used to derive a split intein for use in the methods of the invention. For example, in one aspect the split intein may be derived from a eukaryotic intein. In another aspect, the split intein may be derived from a bacterial intein. In another aspect, the split intein may be derived from an archaeal intein. Preferably, the split intein so-derived will possess only the amino acid sequences essential for catalyzing trans-splicing reactions.

As used herein, the "N-terminal split intein (In)" refers to any intein sequence that comprises an N-terminal amino acid sequence that is functional for trans-splicing reactions. An In thus also comprises a sequence that is spliced out when trans-splicing occurs. An In can comprise a sequence that is a modification of the N-terminal portion of a naturally occurring intein sequence. For example, an In can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the In.

As used herein, the "C-terminal split intein (Ic)" refers to any intein sequence that comprises a C-terminal amino acid sequence that is functional for trans-splicing reactions. In one aspect, the Ic comprises 4 to 7 contiguous amino acid residues, at least 4 amino acids of which are from the last β-strand of the intein from which it was derived. An Ic thus also comprises a sequence that is spliced out when trans-splicing occurs. An Ic can comprise a sequence that is a modification of the C-terminal portion of a naturally occurring intein sequence. For example, an Ic can comprise additional amino acid residues and/or mutated residues so long as the inclusion of such additional and/or mutated residues does not render the In non-functional in trans-splicing. Preferably, the inclusion of the additional and/or mutated residues improves or enhances the trans-splicing activity of the Ic.

In some embodiments of the invention, a peptide linked to an Ic or an In can comprise an additional chemical moiety including, among others, fluorescence groups, biotin, polyethylene glycol (PEG), amino acid analogs, unnatural amino acids, phosphate groups, glycosyl groups, radioisotope labels, and pharmaceutical molecules. In other embodiments, a peptide linked to an Ic can comprise one or more chemically reactive groups including, among others, ketone, aldehyde, Cys residues and Lys residues. The N-intein and C-intein of a split intein can associate non-covalently to form an active intein and catalyze the splicing reaction when an "intein-splicing polypeptide (ISP)" is present. As used herein, "intein-splicing polypeptide (ISP)" refers to the portion of the amino acid sequence of a split intein that remains when the Ic, In, or both, are removed from the split intein. In certain embodiments, the In comprises the ISP. In another embodiment, the Ic comprises the ISP. In yet another embodiment, the ISP is a separate peptide that is not covalently linked to In nor to Ic.

Split inteins may be created from contiguous inteins by engineering one or more split sites in the unstructured loop or intervening amino acid sequence between the −12 conserved beta-strands found in the structure of mini-inteins. Some flexibility in the position of the split site within regions between the beta-strands may exist, provided that creation of the split will not disrupt the structure of the intein, the structured beta-strands in particular, to a sufficient degree that protein splicing activity is lost.

In protein trans-splicing, one precursor protein consists of an N-extein part followed by the N-intein, another precursor protein consists of the C-intein followed by a C-extein part, and a trans-splicing reaction (catalyzed by the N- and C-inteins together) excises the two intein sequences and links the two extein sequences with a peptide bond. Protein trans-splicing, being an enzymatic reaction, can work with very low (e.g. micromolar) concentrations of proteins and can be carried out under physiological conditions.

Exemplary sequences are as follows:

| NAME | SEQUENCE OF LIGAND-DEPENDENT INTEIN |
|---|---|
| 2-4 INTEIN: | CLAEGTRIFDPVTGTTHRIEDVVDGRKPIHVVAAAKDGTLLARPVV SWFDQGTRDVIGLRIAGGAIVWATPDHKVLTEYGWRAAGELRKGD RVAGPGGSGNSLALSLTADQMVSALLDAEPPILYSEYDPTSPFSEAS MMGLLTNLADRELVHMINWAKRVPGFVDLTLHDQAHLLECAWLEI LMIGLVWRSMEHPGKLLFAPNLLLDRNQGKCVEGMVEIFDMLLAT SSRFRMMNLQGEEFVCLKSIILLNSGVYTFLSSTLKSLEEKDHIHRA LDKITDTLIHLMAKAGLTLQQQHQRLAQLLLILSHIRHMSNKGMEH LYSMKYKNVVPLYDLLLEMLDAHRLHAGGSGASRVQAFADALDD KFLHDMLAEELRYSVIREVLPTRRARTFDLEVEELHTLVAEGVVVH NC (SEQ ID NO: 8) |
| 3-2 INTEIN | CLAEGTRIFDPVTGTTHRIEDVVDGRKPIHVVAVAKDGTLLARPVVS WFDQGTRDVIGLRIAGGAIVWATPDHKVLTEYGWRAAGELRKGDR VAGPGGSGNSLALSLTADQMVSALLDAEPPILYSEYDPTSPFSEASM MGLLTNLADRELVHMINWAKRVPGFVDLTLHDQAHLLECAWLEIL MIGLVWRSMEHPGKLLFAPNLLLDRNQGKCVEGMVEIFDMLLATS SRFRMMNLQGEEFVCLKSIILLNSGVYTFLSSTLKSLEEKDHIHRAL DKITDTLIHLMAKAGLTLQQQHQRLAQLLLILSHIRHMSNKGMEHL YSMKYTNVVPLYDLLLEMLDAHRLHAGGSGASRVQAFADALDDK FLHDMLAEELRYSVIREVLPTRRARTFDLEVEELHTLVAEGVVVHN C (SEQ ID NO: 9) |
| 30R3-1 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPIPYSEYDPTSPFSEA SMMGLLTNLADRELVHMINWAKRVPGFVDLTLHDQAHLLECAWL EILMIGLVWRSMEHPGKLLFAPNLLLDRNQGKCVEGMVEIFDMLL ATSSRFRMMNLQGEEFVCLKSIILLNSGVYTFLSSTLKSLEEKDHIH RALDKITDTLIHLMAKAGLTLQQQHQRLAQLLLILSHIRHMSNKGM |

| NAME | SEQUENCE OF LIGAND-DEPENDENT INTEIN |
|---|---|
| | EHLYSMKYKNVVPLYDLLLEMLDAHRLHAGGSGASRVQAFADAL
DDKFLHDMLAEGLRYSVIREVLPTRRARTFDLEVEELHTLVAEGVV
VHNC (SEQ ID NO: 10) |
| 30R3-2 INTEIN | CLAEGTRIFDPVTGTTHRIEDVVDGRKPIHVVAAAKDGTLLARPVV
SWFDQGTRDVIGLRIAGGATVWATPDHKVLTEYGWRAAGELRKG
DRVAGPGGSGNSLALSLTADQMVSALLDAEPPILYSEYDPTSPFSEA
SMMGLLTNLADRELVHMINWAKRVPGFVDLTLHDQAHLLECAWL
EILMIGLVWRSMEHPGKLLFAPNLLLDRNQGKCVEGMVEIFDMLL
ATSSRFRMMNLQGEEFVCLKSIILLNSGVYTFLSSTLKSLEEKDHIH
RALDKITDTLIHLMAKAGLTLQQQHQRLAQLLLILSHIRHMSNKGM
EHLYSMKYKNVVPLYDLLLEMLDAHRLHAGGSGASRVQAFADAL
DDKFLHDMLAEELRYSVIREVLPTRRARTFDLEVEELHTLVAEGVV
VHNC (SEQ ID NO: 11) |
| 30R3-3 INTEIN | CLAEGTRIFDPVTGTTHRIEDVVDGRKPIHVVAAAKDGTLLARPVV
SWFDQGTRDVIGLRIAGGATVWATPDHKVLTEYGWRAAGELRKG
DRVAGPGGSGNSLALSLTADQMVSALLDAEPPIPYSEYDPTSPFSEA
SMMGLLTNLADRELVHMINWAKRVPGFVDLTLHDQAHLLECAWL
EILMIGLVWRSMEHPGKLLFAPNLLLDRNQGKCVEGMVEIFDMLL
ATSSRFRMMNLQGEEFVCLKSIILLNSGVYTFLSSTLKSLEEKDHIH
RALDKITDTLIHLMAKAGLTLQQQHQRLAQLLLILSHIRHMSNKGM
EHLYSMKYKNVVPLYDLLLEMLDAHRLHAGGSGASRVQAFADAL
DDKFLHDMLAEELRYSVIREVLPTRRARTFDLEVEELHTLVAEGVV
VHNC (SEQ ID NO: 12) |
| 37R3-1 INTEIN | CLAEGTRIFDPVTGTTHRIEDVVDGRKPIHVVAAAKDGTLLARPVV
SWFDQGTRDVIGLRIAGGATVWATPDHKVLTEYGWRAAGELRKG
DRVAGPGGSGNSLALSLTADQMVSALLDAEPPILYSEYNPTSPFSEA
SMMGLLTNLADRELVHMINWAKRVPGFVDLTLHDQAHLLERAWL
EILMIGLVWRSMEHPGKLLFAPNLLLDRNQGKCVEGMVEIFDMLL
ATSSRFRMMNLQGEEFVCLKSIILLNSGVYTFLSSTLKSLEEKDHIH
RALDKITDTLIHLMAKAGLTLQQQHQRLAQLLLILSHIRHMSNKGM
EHLYSMKYKNVVPLYDLLLEMLDAHRLHAGGSGASRVQAFADAL
DDKFLHDMLAEGLRYSVIREVLPTRRARTFDLEVEELHTLVAEGVV
VHNC ((SEQ ID NO: 13) |
| 37R3-2 INTEIN | CLAEGTRIFDPVTGTTHRIEDVVDGRKPIHVVAAAKDGTLLARPVV
SWFDQGTRDVIGLRIAGGAIVWATPDHKVLTEYGWRAAGELRKGD
RVAGPGGSGNSLALSLTADQMVSALLDAEPPILYSEYDPTSPFSEAS
MMGLLTNLADRELVHMINWAKRVPGFVDLTLHDQAHLLERAWLEI
LMIGLVWRSMEHPGKLLFAPNLLLDRNQGKCVEGMVEIFDMLLAT
SSRFRMMNLQGEEFVCLKSIILLNSGVYTFLSSTLKSLEEKDHIHRA
LDKITDTLIHLMAKAGLTLQQQHQRLAQLLLILSHIRHMSNKGMEH
LYSMKYKNVVPLYDLLLEMLDAHRLHAGGSGASRVQAFADALDD
KFLHDMLAEGLRYSVIREVLPTRRARTFDLEVEELHTLVAEGVVVH
NC (SEQ ID NO: 14) |
| 37R3-3 INTEIN | CLAEGTRIFDPVTGTTHRIEDVVDGRKPIHVVAVAKDGTLLARPVVS
WFDQGTRDVIGLRIAGGATVWATPDHKVLTEYGWRAAGELRKGD
RVAGPGGSGNSLALSLTADQMVSALLDAEPPILYSEYDPTSPFSEAS
MMGLLTNLADRELVHMINWAKRVPGFVDLTLHDQAHLLERAWLEI
LMIGLVWRSMEHPGKLLFAPNLLLDRNQGKCVEGMVEIFDMLLAT
SSRFRMMNLQGEEFVCLKSIILLNSGVYTFLSSTLKSLEEKDHIHRA
LDKITDTLIHLMAKAGLTLQQQHQRLAQLLLILSHIRHMSNKGMEH
LYSMKYKNVVPLYDLLLEMLDAHRLHAGGSGASRVQAFADALDD
KFLHDMLAEELRYSVIREVLPTRRARTFDLEVEELHTLVAEGVVVH
NC (SEQ ID NO: 15) |

Although inteins are most frequently found as a contiguous domain, some exist in a naturally split form. In this case, the two fragments are expressed as separate polypeptides and must associate before splicing takes place, so-called protein trans-splicing.

An exemplary split intein is the Ssp DnaE intein, which comprises two subunits, namely, DnaE-N and DnaE-C. The two different subunits are encoded by separate genes, namely dnaE-n and dnaE-c, which encode the DnaE-N and DnaE-C subunits, respectively. DnaE is a naturally occurring split intein in *Synechocytis* sp. PCC6803 and is capable of directing trans-splicing of two separate proteins, each comprising a fusion with either DnaE-N or DnaE-C.

Additional naturally occurring or engineered split-intein sequences are known in the or can be made from whole-intein sequences described herein or those available in the art. Examples of split-intein sequences can be found in Stevens et al., "A promiscuous split intein with expanded protein engineering applications," PNAS, 2017, Vol. 114: 8538-8543; Iwai et al., "Highly efficient protein trans-splicing by a naturally split DnaE intein from *Nostc punctiforme*, FEBS Lett, 580: 1853-1858, each of which are incorporated herein by reference. Additional split intein sequences can be found, for example, in WO 2013/045632, WO 2014/055782, WO 2016/069774, and EP2877490, the contents each of which are incorporated herein by reference.

In addition, protein splicing in trans has been described in vivo and in vitro (Shingledecker, et al., *Gene* 207:187 (1998), Southworth, et al., *EMBO J.* 17:918 (1998); Mills, et al., *Proc. Natl. Acad. Sci. USA*, 95:3543-3548 (1998); Lew, et al., *J. Biol. Chem.*, 273:15887-15890 (1998); Wu, et al., *Biochim. Biophys. Acta* 35732:1 (1998b), Yamazaki, et al., *J. Am. Chem. Soc.* 120:5591 (1998), Evans, et al., *J. Biol. Chem.* 275:9091 (2000); Otomo, et al., *Biochemistry* 38:16040-16044 (1999); Otomo, et al., *J. Biolmol. NMR* 14:105-114 (1999); Scott, et al., *Proc. Natl. Acad. Sci. USA* 96:13638-13643 (1999)) and provides the opportunity to express a protein as to two inactive fragments that subsequently undergo ligation to form a functional product, e.g., as shown in FIGS. 66 and 67 with regard to the formation of a complete PE fusion protein from two separately-expressed halves.

E. RNA-Protein Interaction Domain

In various embodiments, two separate protein domains (e.g., a Cas9 domain and a polymerase domain) may be colocalized to one another to form a functional complex (akin to the function of a fusion protein comprising the two separate protein domains) by using an "RNA-protein recruitment system," such as the "MS2 tagging technique." Such systems generally tag one protein domain with an "RNA-protein interaction domain" (aka "RNA-protein recruitment domain") and the other with an "RNA-binding protein" that specifically recognizes and binds to the RNA-protein interaction domain, e.g., a specific hairpin structure. These types of systems can be leveraged to colocalize the domains of a prime editor, as well as to recruitment additional functionalities to a prime editor, such as a UGI domain. In one example, the MS2 tagging technique is based on the natural interaction of the MS2 bacteriophage coat protein ("MCP" or "MS2cp") with a stem-loop or hairpin structure present in the genome of the phage, i.e., the "MS2 hairpin." In the case of the MS2 hairpin, it is recognized and bound by the MS2 bacteriophage coat protein (MCP). Thus, in one exemplary scenario a deaminase-MS2 fusion can recruit a Cas9-MCP fusion.

A review of other modular RNA-protein interaction domains are described in the art, for example, in Johansson et al., "RNA recognition by the MS2 phage coat protein," *Sem Virol.*, 1997, Vol. 8(3): 176-185; Delebecque et al., "Organization of intracellular reactions with rationally designed RNA assemblies," *Science*, 2011, Vol. 333: 470-474; Mali et al., "Cas9 transcriptional activators for target specificity screening and paired nickases for cooperative genome engineering," *Nat. Biotechnol.*, 2013, Vol. 31: 833-838; and Zalatan et al., "Engineering complex synthetic transcriptional programs with CRISPR RNA scaffolds," *Cell*, 2015, Vol. 160: 339-350, each of which are incorporated herein by reference in their entireties. Other systems include the PP7 hairpin, which specifically recruits the PCP protein, and the "corn" hairpin, which specifically recruits the Com protein. See Zalatan et al.

The nucleotide sequence of the MS2 hairpin (or equivalently referred to as the "MS2 aptamer") is: GCCAACATGAGGATCACCCATGTCTGCAGGGCC (SEQ ID NO: 763).

The amino acid sequence of the MCP or MS2cp is:

(SEQ ID NO: 764)
GSASNFTQFVLVDNGGTGDVTVAPSNFANGVAEWISSNSRSQAYKVTCS

VRQSSAQNRKYTIKVEVPKVATQTVGGEELPVAGWRSYLNMELTIPIFA

TNSDCELIVKAMQGLLKDGNPIPSAIAANSGIY.

F. UGI Domain

In other embodiments, the prime editors described herein may comprise one or more uracil glycosylase inhibitor domains. The term "uracil glycosylase inhibitor (UGI)" or "UGI domain," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 3873. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3873. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3873. In some embodiments, a UGI comprises an amino acid sequence homologous to the amino acid sequence set forth in SEQ ID NO: 3873, or an amino acid sequence homologous to a fragment of the amino acid sequence set forth in SEQ ID NO: 3873. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3873. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3873. In some embodiments, the UGI comprises the following amino acid sequence:

Uracil-DNA Glycosylase Inhibitor:
>sp|P14739|UNGI_BPPB2

(SEQ ID NO: 3873)
MTNLSDIIEKETGKQLVIQESILMLPEEVEEVIGNKPESDILVHTAYDE
STDENVMLLTSDAPEYKPWALVIQDSNGENKIKML.

The prime editors described herein may comprise more than one UGI domain, which may be separated by one or more linkers as described herein.

G. Additional PE Elements

In certain embodiments, the prime editors described herein may comprise an inhibitor of base repair. The term "inhibitor of base repair" or "IBR" refers to a protein that is capable in inhibiting the activity of a nucleic acid repair enzyme, for example a base excision repair enzyme. In some embodiments, the IBR is an inhibitor of OGG base excision repair. In some embodiments, the IBR is an inhibitor of base excision repair ("iBER"). Exemplary inhibitors of base excision repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is an iBER that may be a catalytically inactive glycosylase or catalytically inactive dioxygenase or a small molecule or peptide inhibitor of an oxidase, or variants threreof. In some embodiments, the IBR is an iBER that may be a TDG inhibitor, MBD4 inhibitor or an inhibitor of an AlkBH enzyme. In some embodiments, the IBR is an iBER that comprises a catalytically inactive TDG or catalytically inactive MBD4. An exemplary catalytically inactive TDG is an N140A mutant of SEQ ID NO: 3872 (human TDG).

Some exemplary glycosylases are provided below. The catalytically inactivated variants of any of these glycosylase domains are iBERs that may be fused to the napDNAbp or polymerase domain of the prime editors provided in this disclosure.

OGG (Human)

(SEQ ID NO: 3937)
MPARALLPRRMGHRTLASTPALWAS1PCPRSELRLDLVLPSGQSFRWRE

QSPAHWSGVLADQVWTLTQTEEQLHCTVYRGDKSQASRPTPDELEAVRK

YFQLDVTLAQLYHHWGSVDSHFOEVAQKFOGVRLLRODPIECLFSFICS

SNNNIARITGMVERLCQAFGPRLIQLDDVTYHGFPSLQALAGPEVEAHL

RKLGLGYRARYVSASARAILEEQGGLAWLQQLRESSYEEAHKALCILPG

VGTKVADCICLMALDKPQAVPVDVHMWHIAQRDYSWHPTTSQAKGPSPQ

TNKELGNFFRSLWGPYAGWAQAVLFSADLRQSRHAQEPPAKRRKGSKGP

EG

MPG (Human)

(SEQ ID NO: 3938)
MVTPALQMKKPKQFCRRMGQKKQRPARAGQPHSSSDAAQAPAEQPHSSS

DAAQAPCPRERCLGPPTTPGPYRSIYFSSPKGHLTRLGLEFFDQPAVPL

ARAFLGQVLVRRLPNGTELRGRIVETEAYLGPEDEAAHSRGGRQTPRNR

GMFMKPGTLYVYIIYGMYFCMNISSQGDGACVLLRALEPLEGLETMRQL

RSTLRKGTASRVLKDRELCSGPSKLCQALAINKSFDQRDLAQDEAVWLE

RGPLEPSEPAVVAAARVGVGHAGEWARKPLRFYVRGSPWVSVVDRVAEQ

DTQA

MBD4 (Human)

(SEQ ID NO: 3871)
MGTTGLESLSLGDRGAAPTVTSSERLVPDPPNDLRKEDVAMELERVGED

EEQMMIKRSSECNPLLQEPIASAQFGATAGTECRKSVPCGWERVVKQRL

FGKTAGRFDVYFISPQGLKFRSKSSLANYLHKNGETSLKPEDFDFTVLS

KRGIKSRYKDCSMAALTSHLQNQSNNSNWNLRTRSKCKKDVFMPPSSSS

ELQESRGLSNFTSTHLLLKEDEGVDDVNFRKVRKPKGKVTILKGIPIKK

TKKGCRKSCSGFVQSDSKRESVCNKADAESEPVAQKSQLDRTVCISDAG

ACGETLSVTSEENSLVKKKERSLSSGSNFCSEQKTSGIINKFCSAKDSE

HNEKYEDTFLESEEIGTKVEVVERKEHLHTDILKRGSEMDNNCSPTRKD

FTGEKIFQEDTIPRTQIERRKTSLYFSSKYNKEALSPPRRKAFKKWTPP

RSPFNLVQETLFHDPWKLLIATIFLNRTSGKMAIPVLWKFLEKYPSAEV

ARTADWRDVSELLKPLGLYDLRAKTIVKFSDEYLTKQWKYPIELHGIGK

YGNDSYRIFCVNEWKQVHPEDHKLNKYHDWLWENHEKLSLS

TDG (Human)

(SEQ ID NO: 3872)
MEAENAGSYSLQQAQAFYTFPFQQLMAEAPNMAVVNEQQMPEEVPAPAP

AQEPVQEAPKGRKRKPRTTEPKQPVEPKKPVESKKSGKSAKSKEKQEKI

TDTFKVKRKVDRFNGVSEAELLTKTLPDILTFNLDIVIIGINPGLMAAY

KGHHYPGPGNHFWKCLFMSGLSEVQLNHMDDHTLPGKYGIGFTNMVERT

TPGSKDLSSKEFREGGRILVQKLQKYQPRIAVFNGKCIYEIFSKEVFGV

KVKNLEFGLQPHKIPDTETLCYVMPSSSARCAQFPRAQDKVHYYIKLKD

LRDQLKGIERNMDVQEVQYTFDLQLAQEDAKKMAVKEEKYDPGYEAAYG

GAYGENPCSSEPCGFSSNGLIESVELRGESAFSGIPNGQWMTQSFTDQI

PSFSNHCGTQEQEEESHA

In some embodiments, the fusion proteins described herein may comprise one or more heterologous protein domains (e.g., about or more than about 1, 2, 3, 4, 5, 6, 7, 8, 9, 10, or more domains in addition to the prime editor components). A fusion protein may comprise any additional protein sequence, and optionally a linker sequence between any two domains. Other exemplary features that may be present are localization sequences, such as cytoplasmic localization sequences, export sequences, such as nuclear export sequences, or other localization sequences, as well as sequence tags that are useful for solubilization, purification, or detection of the fusion proteins.

Examples of protein domains that may be fused to a prime editor or component thereof (e.g., the napDNAbp domain, the polymerase domain, or the NLS domain) include, without limitation, epitope tags, and reporter gene sequences. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT), beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A prime editor may be fused to a gene sequence encoding a protein or a fragment of a protein that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions. Additional domains that may form part of a prime editor are described in US Patent Publication No. 2011/0059502, published Mar. 10, 2011 and incorporated herein by reference in its entirety.

In an aspect of the disclosure, a reporter gene which includes, but is not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP), may be introduced into a cell to encode a gene product which serves as a marker by which to measure the alteration or modification of expression of the gene product. In certain embodiments of the disclosure the gene product is luciferase. In a further embodiment of the disclosure the expression of the gene product is decreased.

Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

In some embodiments of the present disclosure, the activity of the prime editing system may be temporally regulated by adjusting the residence time, the amount, and/or the activity of the expressed components of the PE system. For example, as described herein, the PE may be fused with a protein domain that is capable of modifying the intracellular half-life of the PE. In certain embodiments involving two or more vectors (e.g., a vector system in which the components described herein are encoded on two or more separate vectors), the activity of the PE system may be temporally regulated by controlling the timing in which the vectors are delivered. For example, in some embodiments a vector encoding the nuclease system may deliver the PE prior to the vector encoding the template. In other embodiments, the vector encoding the PEgRNA may deliver the guide prior to the vector encoding the PE system. In some embodiments, the vectors encoding the PE system and PEgRNA are delivered simultaneously. In certain embodiments, the simultaneously delivered vectors temporally deliver, e.g., the PE, PEgRNA, and/or second strand guide RNA components. In further embodiments, the RNA (such as, e.g., the nuclease transcript) transcribed from the coding sequence on the vectors may further comprise at least one element that is capable of modifying the intracellular half-life of the RNA and/or modulating translational control. In some embodiments, the half-life of the RNA may be increased. In some embodiments, the half-life of the RNA may be decreased. In some embodiments, the element may be capable of increasing the stability of the RNA. In some embodiments, the element may be capable of decreasing the stability of the RNA. In some embodiments, the element may be within the 3' UTR of the RNA. In some embodiments, the element may include a polyadenylation signal (PA). In some embodiments, the element may include a cap, e.g., an upstream mRNA or PEgRNA end. In some embodiments, the RNA may comprise no PA such that it is subject to quicker degradation in the cell after transcription. In some embodiments, the element may include at least one AU-rich element (ARE). The AREs may be bound by ARE binding proteins (ARE-BPs) in a manner that is dependent upon tissue type, cell type, timing, cellular localization, and environment. In some embodiments the destabilizing element may promote RNA decay, affect RNA stability, or activate translation. In some embodiments, the ARE may comprise 50 to 150 nucleotides in length. In some embodiments, the ARE may comprise at least one copy of the sequence AUUUA. In some embodiments, at least one ARE may be added to the 3' UTR of the RNA. In some embodiments, the element may be a Woodchuck Hepatitis Virus (WHP).

Posttranscriptional Regulatory Element (WPRE), which creates a tertiary structure to enhance expression from the transcript. In further embodiments, the element is a modified and/or truncated WPRE sequence that is capable of enhancing expression from the transcript, as described, for example in Zufferey et al., J Virol, 73(4): 2886-92 (1999) and Flajolet et al., J Virol, 72(7): 6175-80 (1998). In some embodiments, the WPRE or equivalent may be added to the 3' UTR of the RNA. In some embodiments, the element may be selected from other RNA sequence motifs that are enriched in either fast- or slow-decaying transcripts.

In some embodiments, the vector encoding the PE or the PEgRNA may be self-destroyed via cleavage of a target sequence present on the vector by the PE system. The cleavage may prevent continued transcription of a PE or a PEgRNA from the vector. Although transcription may occur on the linearized vector for some amount of time, the expressed transcripts or proteins subject to intracellular degradation will have less time to produce off-target effects without continued supply from expression of the encoding vectors.

[6] PEgRNAs

The prime editing system described herein contemplates the use of any suitable PEgRNAs. The inventors have discovered that the mechanism of target-primed reverse transcription (TPRT) can be leveraged or adapted for conducting precision and versatile CRISPR/Cas-based genome editing through the use of a specially configured guide RNA comprising a reverse transcription (RT) template sequence that codes for the desired nucleotide change. The application refers to this specially configured guide RNA as an "extended guide RNA" or a "PEgRNA" since the RT template sequence can be provided as an extension of a standard or traditional guide RNA molecule. The application contemplates any suitable configuration or arrangement for the extended guide RNA.

PEgRNA Architecture

FIG. 3A shows one embodiment of an extended guide RNA usable in the prime editing system disclosed herein whereby a traditional guide RNA (the green portion) includes a ~20 nt protospacer sequence and a gRNA core region, which binds with the napDNAbp. In this embodiment, the guide RNA includes an extended RNA segment at the 5' end, i.e., a 5' extension. In this embodiment, the 5' extension includes a reverse transcription template sequence, a reverse transcription primer binding site, and an optional 5-20 nucleotide linker sequence. As shown in FIGS. 1A-1B, the RT primer binding site hybrizes to the free 3' end that is formed after a nick is formed in the non-target strand of the R-loop, thereby priming reverse transcriptase for DNA polymerization in the 5'-3' direction.

FIG. 3B shows another embodiment of an extended guide RNA usable in the prime editing system disclosed herein whereby a traditional guide RNA (the green portion) includes a ~20 nt protospacer sequence and a gRNA core, which binds with the napDNAbp. In this embodiment, the guide RNA includes an extended RNA segment at the 3' end, i.e., a 3' extension. In this embodiment, the 3' extension includes a reverse transcription template sequence, and a reverse transcription primer binding site. As shown in FIGS. 1C-1D, the RT primer binding site hybrizes to the free 3' end that is formed after a nick is formed in the non-target strand of the R-loop, thereby priming reverse transcriptase for DNA polymerization in the 5'-3' direction.

FIG. 3C shows another embodiment of an extend guide RNA usable in the prime editing system disclosed herein whereby a traditional guide RNA (the green portion) includes a ~20 nt protospacer sequence and a gRNA core, which binds with the napDNAbp. In this embodiment, the guide RNA includes an extended RNA segment at an intermolecular position within the gRNA core, i.e., an intramolecular extension. In this embodiment, the intramolecular extension includes a reverse transcription template sequence, and a reverse transcription primer binding site. The RT primer binding site hybrizes to the free 3' end that is formed after a nick is formed in the non-target strand of the R-loop, thereby priming reverse transcriptase for DNA polymerization in the 5'-3' direction.

In one embodiment, the position of the intermolecular RNA extension is not in the protospacer sequence of the guide RNA. In another embodiment, the position of the intermolecular RNA extension in the gRNA core. In still another embodiment, the position of the intermolecular RNA extension is any with the guide RNA molecule except within the protospacer sequence, or at a position which disrupts the protospacer sequence.

In one embodiment, the intermolecular RNA extension is inserted downstream from the 3' end of the protospacer sequence. In another embodiment, the intermolecular RNA extension is inserted at least 1 nucleotide, at least 2 nucleotides, at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides downstream of the 3' end of the protospacer sequence.

In other embodiments, the intermolecular RNA extension is inserted into the gRNA, which refers to the portion of the guide RNA corresponding or comprising the tracrRNA, which binds and/or interacts with the Cas9 protein or equivalent thereof (i.e, a different napDNAbp). Preferably the insertion of the intermolecular RNA extension does not disrupt or minimally disrupts the interaction between the tracrRNA portion and the napDNAbp.

The length of the RNA extension can be any useful length. In various embodiments, the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

The RT template sequence can also be any suitable length. For example, the RT template sequence can be at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

In still other embodiments, wherein the reverse transcription primer binding site sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

In other embodiments, the optional linker or spacer sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, or at least 500 nucleotides in length.

The RT template sequence, in certain embodiments, encodes a single-stranded DNA molecule which is homologous to the non-target strand (and thus, complementary to the corresponding site of the target strand) but includes one or more nucleotide changes. The least one nucleotide change may include one or more single-base nucleotide changes, one or more deletions, and one or more insertions.

As depicted in FIG. 1G, the synthesized single-stranded DNA product of the RT template sequence is homologous to the non-target strand and contains one or more nucleotide changes. The single-stranded DNA product of the RT template sequence hybridizes in equilibrium with the complementary target strand sequence, thereby displacing the homologous endogenous target strand sequence. The displaced endogenous strand may be referred to in some embodiments as a 5' endogenous DNA flap species (e.g., see FIG. 1E). This 5' endogenous DNA flap species can be removed by a 5' flap endonuclease (e.g., FEN1) and the single-stranded DNA product, now hybridized to the endogenous target strand, may be ligated, thereby creating a mismatch between the endogenous sequence and the newly synthesized strand. The mismatch may be resolved by the cell's innate DNA repair and/or replication processes.

In various embodiments, the nucleotide sequence of the RT template sequence corresponds to the nucleotide sequence of the non-target strand which becomes displaced as the 5' flap species and which overlaps with the site to be edited.

In various embodiments of the extended guide RNAs, the reverse transcription template sequence may encode a single-strand DNA flap that is complementary to an endogenous DNA sequence adjacent to a nick site, wherein the single-strand DNA flap comprises a desired nucleotide change. The single-stranded DNA flap may displace an endogenous single-strand DNA at the nick site. The displaced endogenous single-strand DNA at the nick site can have a 5' end and form an endogenous flap, which can be excised by the cell. In various embodiments, excision of the 5' end endogenous flap can help drive product formation since removing the 5' end endogenous flap encourages hybridization of the single-strand 3' DNA flap to the corresponding complementary DNA strand, and the incorporation or assimilation of the desired nucleotide change carried by the single-strand 3' DNA flap into the target DNA.

In various embodiments of the extended guide RNAs, the cellular repair of the single-strand DNA flap results in installation of the desired nucleotide change, thereby forming a desired product.

In still other embodiments, the desired nucleotide change is installed in an editing window that is between about −5 to +5 of the nick site, or between about −10 to +10 of the nick site, or between about −20 to +20 of the nick site, or between about −30 to +30 of the nick site, or between about −40 to +40 of the nick site, or between about −50 to +50 of the nick site, or between about −60 to +60 of the nick site, or between about −70 to +70 of the nick site, or between about −80 to +80 of the nick site, or between about −90 to +90 of the nick site, or between about −100 to +100 of the nick site, or between about −200 to +200 of the nick site.

In other embodiments, the desired nucleotide change is installed in an editing window that is between about +1 to +2 from the nick site, or about +1 to +3, +1 to +4, +1 to +5, +1 to +6, +1 to +7, +1 to +8, +1 to +9, +1 to +10, +1 to +11, +1 to +12, +1 to +13, +1 to +14, +1 to +15, +1 to +16, +1 to +17, +1 to +18, +1 to +19, +1 to +20, +1 to +21, +1 to +22, +1 to +23, +1 to +24, +1 to +25, +1 to +26, +1 to +27, +1 to +28, +1 to +29, +1 to +30, +1 to +31, +1 to +32, +1 to +33, +1 to +34, +1 to +35, +1 to +36, +1 to +37, +1 to +38, +1 to +39, +1 to +40, +1 to +41, +1 to +42, +1 to +43, +1 to +44, +1 to +45, +1 to +46, +1 to +47, +1 to +48, +1 to +49, +1 to +50, +1 to +51, +1 to +52, +1 to +53, +1 to +54, +1 to +55, +1 to +56, +1 to +57, +1 to +58, +1 to +59, +1 to +60, +1 to +61, +1 to +62, +1 to +63, +1 to +64, +1 to +65, +1 to +66, +1 to +67, +1 to +68, +1 to +69, +1 to +70, +1 to +71, +1 to +72, +1 to +73, +1 to +74, +1 to +75, +1 to +76, +1 to +77, +1 to +78, +1 to +79, +1 to +80, +1 to +81, +1 to +82, +1 to +83, +1 to +84, +1 to +85, +1 to +86, +1 to +87, +1 to +88, +1 to +89, +1 to +90, +1 to +90, +1 to +91, +1 to +92, +1 to +93, +1 to +94, +1 to +95, +1 to +96, +1 to +97, +1 to +98, +1 to +99, +1 to +100, +1 to +101, +1 to +102, +1 to +103, +1 to +104, +1 to +105, +1 to +106, +1 to +107, +1 to +108, +1 to +109, +1 to +110, +1 to +111, +1 to +112, +1 to +113, +1 to +114, +1 to +115, +1 to +116, +1 to +117, +1 to +118, +1 to +119, +1 to +120, +1 to +121, +1 to +122, +1 to +123, +1 to +124, or +1 to +125 from the nick site.

In still other embodiments, the desired nucleotide change is installed in an editing window that is between about +1 to +2 from the nick site, or about +1 to +5, +1 to +10, +1 to +15, +1 to +20, +1 to +25, +1 to +30, +1 to +35, +1 to +40, +1 to +45, +1 to +50, +1 to +55, +1 to +100, +1 to +105, +1 to +110, +1 to +115, +1 to +120, +1 to +125, +1 to +130, +1 to +135, +1 to +140, +1 to +145, +1 to +150, +1 to +155, +1 to +160, +1 to +165, +1 to +170, +1 to +175, +1 to +180, +1 to +185, +1 to +190, +1 to +195, or +1 to +200, from the nick site.

In various aspects, the extended guide RNAs are modified versions of a guide RNA. Guide RNAs maybe naturally occurring, expressed from an encoding nucleic acid, or synthesized chemically. Methods are well known in the art for obtaining or otherwise synthesizing guide RNAs and for determining the appropriate sequence of the guide RNA, including the protospacer sequence which interacts and hybridizes with the target strand of a genomic target site of interest.

In various embodiments, the particular design aspects of a guide RNA sequence will depend upon the nucleotide sequence of a genomic target site of interest (i.e., the desired site to be edited) and the type of napDNAbp (e.g., Cas9 protein) present in prime editing systems described herein, among other factors, such as PAM sequence locations, percent G/C content in the target sequence, the degree of microhomology regions, secondary structures, etc.

In general, a guide sequence is any polynucleotide sequence having sufficient complementarity with a target polynucleotide sequence to hybridize with the target sequence and direct sequence-specific binding of a napDNAbp (e.g., a Cas9, Cas9 homolog, or Cas9 variant) to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length.

In some embodiments, a guide sequence is less than about 75, 50, 45, 40, 35, 30, 25, 20, 15, 12, or fewer nucleotides in length. The ability of a guide sequence to direct sequence-specific binding of a prime editor (PE) to a target sequence may be assessed by any suitable assay. For example, the components of a prime editor (PE), including the guide sequence to be tested, may be provided to a host cell having the corresponding target sequence, such as by transfection with vectors encoding the components of a prime editor (PE) disclosed herein, followed by an assessment of preferential cleavage within the target sequence, such as by Surveyor assay as described herein. Similarly, cleavage of a target polynucleotide sequence may be evaluated in a test tube by providing the target sequence, components of a prime editor (PE), including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence may be selected to target any target sequence. In some embodiments, the target sequence is a sequence within a genome of a cell. Exemplary target sequences include those that are unique in the target genome. For example, for the *S. pyogenes* Cas9, a unique target sequence in a genome may include a Cas9 target site of the form MMMMMMMMMNNNNNNNNNNNNXGG (SEQ ID NO: 204) where NNNNNNNNNNNNXGG (SEQ ID NO: 205) (N is A, G, T, or C; and X can be anything). A unique target sequence in a genome may include an *S. pyogenes* Cas9 target site of the form MMMMMMMMMNNNNNNNNNNNXGG (SEQ ID NO: 206) where (SEQ ID NO: 207)
NNNNNNNNNNNXGG (N is A, G, T, or C; and X can be anything). For the *S. thermophilus* CRISPR1Cas9, a unique target sequence in a genome may include a Cas9 target site of the form MMMMMMMMMNNNNNNNNNNNNXXAGAAW (SEQ ID NO: 208) where NNNNNNNNNNNNNXXAGAAW (SEQ ID NO: 209) (N is A, G, T, or C; X can be anything; and W is A or T). A unique target sequence in a genome may include an *S. thermophilus* CRISPR 1 Cas9 target site of the form MMMMMMMMMNNNNNNNNNNNNXXAGAAW (SEQ ID NO: 210) where NNNNNNNNNNNXXAGAAW (SEQ ID NO: 211) (N is A, G, T, or C; X can be anything; and W is A or T). For the *S. pyogenes* Cas9, a unique target sequence in a genome may include a Cas9 target site of the form MMMMMMMMMNNNNNNNNNNNNXGGXG (SEQ ID NO: 212) where NNNNNNNNNNNNXGGXG (SEQ ID NO: 213) (N is A, G, T, or C; and X can be anything). A unique target sequence in a genome may include an *S. pyogenes* Cas9 target site of the form MMMMMMMMMNNNNNNNNNNNNXGGXG (SEQ ID NO: 214) where NNNNNNNNNNNXGGXG (SEQ ID NO: 215) (N is A, G, T, or C; and X can be anything). In each of these sequences "M" may be A, G, T, or C, and need not be considered in identifying a sequence as unique.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and P A Carr and G M Church, 2009, Nature Biotechnology 27(12): 1151-62). Further algorithms may be found in U.S. application Ser. No. 61/836,080; Broad Reference BI-2013/004A); incorporated herein by reference.

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a complex at a target sequence, wherein the complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. Preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In some embodiments, the single transcript further includes a transcription termination sequence; preferably this is a polyT sequence, for example six T nucleotides. Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator:

```
                                     (SEQ ID NO: 216)
(1)NNNNNNNNNGTTTTTGTACTCTCAAGATTTAGAAATAAATCTTGCAG
AAGCTACAAAGATAAGGCTTCATGCCGAAATCAACACCCTGTCATTTTA
TGGCAGGGTGTTTTCGTTATTTAATTTTTT;

(SEQ ID NO: 217)
(2)NNNNNNNNNNNNNNNNNNNGTTTTTGTACTCTCAGAAATGCAGAAGC
TACAAAGATAAGGCTTCATGCCGAAATCAACACCCTGTCATTTTATGGC
AGGGTGTTTTCGTTATTTAATTTTTT;

(SEQ ID NO: 218)
(3)NNNNNNNNNNNNNNNNNNNNGTTTTTGTACTCTCAGAAATGCAGAA
GCTACAAAGATAAGGCTTCATGCCGAAATCAACACCCTGTCATTTTATG
GCAGGGTGTTTTTT;

(SEQ ID NO: 219)
(4)NNNNNNNNNNNNNNNNNNNNGTTTTAGAGCTAGAAATAGCAAGTTA
AAATAAGGCTAGTCCGTTATCAACTTGAAAAAGTGGCACCGAGTCGGTG
CTTTTTT;

(SEQ ID NO: 220)
(5)NNNNNNNNNNNNNNNNNNNNGTTTTAGAGCTAGAAATAGCAAGTTA
AAATAAGGCTAGTCCGTTATCAACTTGAAAAAGTGTTTTTTT; AND (SEQ ID NO: 221)
(6) NNNNNNNNNNNNNNNNNNNNGTTTTAGAGCTAGAAATAGCAAGTT
AAAATAAGGCTAGTCCGTTATCATTTTTTTT.
```

In some embodiments, sequences (1) to (3) are used in combination with Cas9 from *S. thermophilus* CRISPR1. In some embodiments, sequences (4) to (6) are used in combination with Cas9 from *S. pyogenes*. In some embodiments, the tracr sequence is a separate transcript from a transcript comprising the tracr mate sequence.

It will be apparent to those of skill in the art that in order to target any of the fusion proteins comprising a Cas9 domain and a single-stranded DNA binding protein, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein.

In some embodiments, the guide RNA comprises a structure 5'-[guide sequence]—

```
                                     (SEQ ID NO: 222)
5'-[guide sequence]-GUUUUAGAGCUAGAAAUAGCAAGUUAAAAU

AAAGGCUAGUCCGUUAUCAACUUGAAAAAGUGGCACCGAGUCGGUGCUUU

UU-3',
``` wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are well known in the art and can be used with the prime editor (PE) described herein.

In other embodiments, the PEgRNAs include those depicted in FIG. 3D.

In still other embodiments, the PEgRNAs may include those depicted in FIG. 3E.

FIG. 3D provides the structure of an embodiment of a PEgRNA contemplated herein and which may be designed in accordance with the methodology defined in Example 2. The PEgRNA comprises three main component elements ordered in the 5' to 3' direction, namely: a spacer, a gRNA core, and an extension arm at the 3' end. The extension arm may further be divided into the following structural elements in the 5' to 3' direction, namely: a primer binding site (A), an edit template (B), and a homology arm (C). In addition, the PEgRNA may comprise an optional 3' end modifier region (e1) and an optional 5' end modifier region (e2). Still further, the PEgRNA may comprise a transcriptional termination signal at the 3' end of the PEgRNA (not depicted). These structural elements are further defined herein. The depiction of the structure of the PEgRNA is not meant to be limiting and embraces variations in the arrangement of the elements. For example, the optional sequence modifiers (e1) and (e2) could be positioned within or between any of the other regions shown, and not limited to being located at the 3' and 5' ends.

FIG. 3E provides the structure of another embodiment of a PEgRNA contemplated herein and which may be designed in accordance with the methodology defined in Example 2. The PEgRNA comprises three main component elements ordered in the 5' to 3' direction, namely: a spacer, a gRNA core, and an extension arm at the 3' end. The extension arm may further be divided into the following structural elements in the 5' to 3' direction, namely: a primer binding site (A), an edit template (B), and a homology arm (C). In addition, the PEgRNA may comprise an optional 3' end modifier region (e1) and an optional 5' end modifier region (e2). Still further, the PEgRNA may comprise a transcriptional termination signal on the 3' end of the PEgRNA (not depicted). These structural elements are further defined herein. The depiction of the structure of the PEgRNA is not meant to be limiting and embraces variations in the arrangement of the elements. For example, the optional sequence modifiers (e1) and (e2) could be positioned within or between any of the other regions shown, and not limited to being located at the 3' and 5' ends.

PEgRNA Improvements

The PEgRNAs may also include additional design improvements that may modify the properties and/or characteristics of PEgRNAs thereby improving the efficacy of prime editing. In various embodiments, these improvements may belong to one or more of a number of different categories, including but not limited to: (1) designs to enable efficient expression of functional PEgRNAs from non-polymerase III (pol III) promoters, which would enable the expression of longer PEgRNAs without burdensome sequence requirements; (2) improvements to the core, Cas9-binding PEgRNA scaffold, which could improve efficacy; (3) modifications to the PEgRNA to improve RT processivity, enabling the insertion of longer sequences at targeted genomic loci; and (4) addition of RNA motifs to the 5' or 3' termini of the PEgRNA that improve PEgRNA stability, enhance RT processivity, prevent misfolding of the PEgRNA, or recruit additional factors important for genome editing.

In one embodiment, PEgRNA could be designed with polIII promoters to improve the expression of longer-length PEgRNA with larger extension arms. sgRNAs are typically expressed from the U6 snRNA promoter. This promoter recruits pol III to express the associated RNA and is useful for expression of short RNAs that are retained within the nucleus. However, pol III is not highly processive and is unable to express RNAs longer than a few hundred nucleotides in length at the levels required for efficient genome editing. Additionally, pol III can stall or terminate at stretches of U's, potentially limiting the sequence diversity that could be inserted using a PEgRNA. Other promoters that recruit polymerase II (such as pCMV) or polymerase I (such as the U1 snRNA promoter) have been examined for their ability to express longer sgRNAs. However, these promoters are typically partially transcribed, which would result in extra sequence 5' of the spacer in the expressed PEgRNA, which has been shown to result in markedly reduced Cas9:sgRNA activity in a site-dependent manner. Additionally, while pol III-transcribed PEgRNAs can simply terminate in a run of 6-7 U's, PEgRNAs transcribed from pol II or pol I would require a different termination signal. Often such signals also result in polyadenylation, which would result in undesired transport of the PEgRNA from the nucleus. Similarly, RNAs expressed from pol II promoters such as pCMV are typically 5'-capped, also resulting in their nuclear export.

Previously, Rinn and coworkers screened a variety of expression platforms for the production of long-noncoding RNA-(lncRNA) tagged sgRNAs[183]. These platforms include RNAs expressed from pCMV and that terminate in the ENE element from the MALAT1 ncRNA from humans[184], the PAN ENE element from KSHV[185], or the 3' box from U1 snRNA[186]. Notably, the MALAT1 ncRNA and PAN ENEs form triple helices protecting the polyA-tail[184, 187]. These constructs could also enhance RNA stability. It is contemplated that these expression systems will also enable the expression of longer PEgRNAs.

In addition, a series of methods have been designed for the cleavage of the portion of the pol II promoter that would be transcribed as part of the PEgRNA, adding either a self-cleaving ribozyme such as the hammerhead[188], pistol[189], hatchet[189], hairpin[190], VS[191], twister[192], or twister sister[192] ribozymes, or other self-cleaving elements to process the transcribed guide, or a hairpin that is recognized by Csy4[193] and also leads to processing of the guide. Also, it is hypothesized that incorporation of multiple ENE motifs could lead to improved PEgRNA expression and stability, as previously demonstrated for the KSHV PAN RNA and element[185]. It is also anticipated that circularizing the PEgRNA in the form of a circular intronic RNA (ciRNA) could also lead to enhanced RNA expression and stability, as well as nuclear localization[194].

In various embodiments, the PEgRNA may include various above elements, as exemplified by the following sequence.

Non-Limiting Example 1—PEgRNA Expression Platform Consisting of pCMV, Csy4 Hairpin, the PEgRNA, and MALAT1 ENE (SEQ ID NO: 223)
TAGTTATTAATAGTAATCAATTACGGGGTCATTAGTTCATAGCCCATATAT

GGAGTTCCGCGTTACATAACTTACGGTAAATGGCCCGCCTGGCTGACCGCC

CAACGACCCCCGCCCATTGACGTCAATAATGACGTATGTTCCCATAGTAAC

GCCAATAGGGACTTTCCATTGACGTCAATGGGTGGAGTATTTACGGTAAAC

TGCCCACTTGGCAGTACATCAAGTGTATCATATGCCAAGTACGCCCCCTAT

TGACGTCAATGACGGTAAATGGCCCGCCTGGCATTATGCCCAGTACATGAC

CTTATGGGACTTTCCTACTTGGCAGTACATCTACGTATTAGTCATCGCTAT

TACCATGGTGATGCGGTTTTGGCAGTACATCAATGGGCGTGGATAGCGGTT

TGACTCACGGGGATTTCCAAGTCTCCACCCCATTGACGTCAATGGGAGTTT

GTTTTGGCACCAAAATCAACGGGACTTTCCAAAATGTCGTAACAACTCCGC

CCCATTGACGCAAATGGGCGGTAGGCGTGTACGGTGGGAGGTCTATATAAG

CAGAGCTGGTTTAGTGAACCGTCAGATCGTTCACTGCCGTATAGGCAGGGC

CCAGACTGAGCACGTGAGTTTTAGAGCTAGAAATAGCAAGTTAAAATAAGG

CTAGTCCGTTATCAACTTGAAAAAGTGGGACCGAGTCGGTCCTCTGCCATC

AAAGCGTGCTCAGTCTGTTTTAGGGTCATGAAGGTTTTTCTTTTCCTGAGA

AAACAACACGTATTGTTTTCTCAGGTTTTGCTTTTTGGCCTTTTTCTAGCT

TAAAAAAAAAAAAAGCAAAGATGCTGGTGGTTGGCACTCCTGGTTTCCAG

GACGGGGTTCAAATCCCTGCGGCGTCTTTGCTTTGACT

Non-Limiting Example 2—PEgRNA Expression Platform Consisting of pCMV, Csy4 Hairing, the PEgRNA, and PAN ENE (SEQ ID NO: 224)
TAGTTATTAATAGTAATCAATTACGGGGTCATTAGTTCATAGCCCATATAT

GGAGTTCCGCGTTACATAACTTACGGTAAATGGCCCGCCTGGCTGACCGCC

CAACGACCCCCGCCCATTGACGTCAATAATGACGTATGTTCCCATAGTAAC

GCCAATAGGGACTTTCCATTGACGTCAATGGGTGGAGTATTTACGGTAAAC

TGCCCACTTGGCAGTACATCAAGTGTATCATATGCCAAGTACGCCCCCTAT

TGACGTCAATGACGGTAAATGGCCCGCCTGGCATTATGCCCAGTACATGAC

CTTATGGGACTTTCCTACTTGGCAGTACATCTACGTATTAGTCATCGCTAT

TACCATGGTGATGCGGTTTTGGCAGTACATCAATGGGCGTGGATAGCGGTT

TGACTCACGGGGATTTCCAAGTCTCCACCCCATTGACGTCAATGGGAGTTT

GTTTTGGCACCAAAATCAACGGGACTTTCCAAAATGTCGTAACAACTCCGC

CCCATTGACGCAAATGGGCGGTAGGCGTGTACGGTGGGAGGTCTATATAAG

CAGAGCTGGTTTAGTGAACCGTCAGATCGTTCACTGCCGTATAGGCAGGGC

CCAGACTGAGCACGTGAGTTTTAGAGCTAGAAATAGCAAGTTAAAATAAGG

CTAGTCCGTTATCAACTTGAAAAAGTGGGACCGAGTCGGTCCTCTGCCATC

AAAGCGTGCTCAGTCTGTTTTGTTTTGGCTGGGTTTTTCCTTGTTCGCACC

GGACACCTCCAGTGACCAGACGGCAAGGTTTTTATCCCAGTGTATATTGGA

AAAACATGTTATACTTTTGACAATTTAACGTGCCTAGAGCTCAAATTAAAC

TAATACCATAACGTAATGCAACTTACAACATAAATAAAGGTCAATGTTTAA

TCCATAAAAAAAAAAAAAAAAAAA

Non-Limiting Example 3—PEgRNA Expression Platform Consisting of pCMV, Csy4 Hairing, the PEgRNA, and 3xPAN ENE (SEQ ID NO: 225)
TAGTTATTAATAGTAATCAATTACGGGGTCATTAGTTCATAGCCCATATAT

GGAGTTCCGCGTTACATAACTTACGGTAAATGGCCCGCCTGGCTGACCGCC

CAACGACCCCCGCCCATTGACGTCAATAATGACGTATGTTCCCATAGTAAC

GCCAATAGGGACTTTCCATTGACGTCAATGGGTGGAGTATTTACGGTAAAC

TGCCCACTTGGCAGTACATCAAGTGTATCATATGCCAAGTACGCCCCCTAT

TGACGTCAATGACGGTAAATGGCCCGCCTGGCATTATGCCCAGTACATGAC

CTTATGGGACTTTCCTACTTGGCAGTACATCTACGTATTAGTCATCGCTAT

TACCATGGTGATGCGGTTTTGGCAGTACATCAATGGGCGTGGATAGCGGTT

TGACTCACGGGGATTTCCAAGTCTCCACCCCATTGACGTCAATGGGAGTTT

GTTTTGGCACCAAAATCAACGGGACTTTCCAAAATGTCGTAACAACTCCGC

CCCATTGACGCAAATGGGCGGTAGGCGTGTACGGTGGGAGGTCTATATAAG

CAGAGCTGGTTTAGTGAACCGTCAGATCGTTCACTGCCGTATAGGCAGGGC

CCAGACTGAGCACGTGAGTTTTAGAGCTAGAAATAGCAAGTTAAAATAAGG

CTAGTCCGTTATCAACTTGAAAAAGTGGGACCGAGTCGGTCCTCTGCCATC

AAAGCGTGCTCAGTCTGTTTTGTTTTGGCTGGGTTTTTCCTTGTTCGCACC

GGACACCTCCAGTGACCAGACGGCAAGGTTTTTATCCCAGTGTATATTGGA

AAAACATGTTATACTTTTGACAATTTAACGTGCCTAGAGCTCAAATTAAAC

TAATACCATAACGTAATGCAACTTACAACATAAATAAAGGTCAATGTTTAA

TCCATAAAAAAAAAAAAAAAAAAAACACACTGTTTTGGCTGGGTTTTTCCT

TGTTCGCACCGGACACCTCCAGTGACCAGACGGCAAGGTTTTTATCCCAGT

GTATATTGGAAAAACATGTTATACTTTTGACAATTTAACGTGCCTAGAGCT

CAAATTAAACTAATACCATAACGTAATGCAACTTACAACATAAATAAAGGT

CAATGTTTAATCCATAAAAAAAAAAAAAAAAAAATCTCTCTGTTTTGGCTG

GGTTTTTCCTTGTTCGCACCGGACACCTCCAGTGACCAGACGGCAAGGTTT

TTATCCCAGTGTATATTGGAAAAACATGTTATACTTTTGACAATTTAACGT

GCCTAGAGCTCAAATTAAACTAATACCATAACGTAATGCAACTTACAACAT

AAATAAAGGTCAATGTTTAATCCATAAAAAAAAAAAAAAAAAAAA

Non-Limiting Example 4—PEgRNA Expression Platform Consisting of pCMV, Csy4 Hairing, the PEgRNA, and 3' Box (SEQ ID NO: 226)
TAGTTATTAATAGTAATCAATTACGGGGTCATTAGTTCATAGCCCATATAT

GGAGTTCCGCGTTACATAACTTACGGTAAATGGCCCGCCTGGCTGACCGCC

CAACGACCCCCGCCCATTGACGTCAATAATGACGTATGTTCCCATAGTAAC

GCCAATAGGGACTTTCCATTGACGTCAATGGGTGGAGTATTTACGGTAAAC

TGCCCACTTGGCAGTACATCAAGTGTATCATATGCCAAGTACGCCCCCTAT

TGACGTCAATGACGGTAAATGGCCCGCCTGGCATTATGCCCAGTACATGAC

CTTATGGGACTTTCCTACTTGGCAGTACATCTACGTATTAGTCATCGCTAT

TACCATGGTGATGCGGTTTTGGCAGTACATCAATGGGCGTGGATAGCGGTT

TGACTCACGGGGATTTCCAAGTCTCCACCCCATTGACGTCAATGGGAGTTT

GTTTTGGCACCAAAATCAACGGGACTTTCCAAAATGTCGTAACAACTCCGC

CCCATTGACGCAAATGGGCGGTAGGCGTGTACGGTGGGAGGTCTATATAAG

CAGAGCTGGTTTAGTGAACCGTCAGATCGTTCACTGCCGTATAGGCAGGGC

CCAGACTGAGCACGTGAGTTTTAGAGCTAGAAATAGCAAGTTAAAATAAGG

CTAGTCCGTTATCAACTTGAAAAAGTGGGACCGAGTCGGTCCTCTGCCATC

AAAGCGTGCTCAGTCTGTTTGTTTCAAAAGTAGACTGTACGCTAAGGGTCA

TATCTTTTTTTGTTTGGTTTGTGTCTTGGTTGGCGTCTTAAA

Non-Limiting Example 5—PEgRNA Expression Platform Consisting of pU1, Csy4 Hairping, the PEgRNA, and 3' Box (SEQ ID NO: 227)
CTAAGGACCAGCTTCTTTGGGAGAGAACAGACGCAGGGGCGGGAGGGAAAA

AGGGAGAGGCAGACGTCACTTCCCCTTGGCGGCTCTGGCAGCAGATTGGTC

GGTTGAGTGGCAGAAAGGCAGACGGGGACTGGGCAAGGCACTGTCGGTGAC

ATCACGGACAGGGCGACTTCTATGTAGATGAGGCAGCGCAGAGGCTGCTGC

TTCGCCACTTGCTGCTTCACCACGAAGGAGTTCCCGTGCCCTGGGAGCGGG

TTCAGGACCGCTGATCGGAAGTGAGAATCCCAGCTGTGTGTCAGGGCTGGA

AAGGGCTCGGGAGTGCGCGGGCAAGTGACCGTGTGTGTAAAGAGTGAGGC

GTATGAGGCTGTGTCGGGGCAGAGGCCCAAGATCTCAGTTCACTGCCGTAT

AGGCAGGGCCCAGACTGAGCACGTGAGTTTTAGAGCTAGAAATAGCAAGTT

AAAATAAGGCTAGTCCGTTATCAACTTGAAAAAGTGGGACCGAGTCGGTCC

TCTGCCATCAAAGCGTGCTCAGTCTGTTTCAGCAAGTTCAGAGAAATCTGA

ACTTGCTGGATTTTTGGAGCAGGGAGATGGAATAGGAGCTTGCTCCGTCCA

CTCCACGCATCGACCTGGTATTGCAGTACCTCCAGGAACGGTGCACCCACT

TTCTGGAGTTTCAAAAGTAGACTGTACGCTAAGGGTCATATCTTTTTTGT

TTGGTTTGTGTCTTGGTTGGCGTCTTAAA.

In various other embodiments, the PEgRNA may be improved by introducing improvements to the scaffold or core sequences. This can be done by introducing known The core, Cas9-binding PEgRNA scaffold can likely be improved to enhance PE activity. Several such approaches have already been demonstrated. For instance, the first pairing element of the scaffold (P1) contains a GTTTT-AAAAC (SEQ ID NO: 3939) pairing element. Such runs of Ts have been shown to result in pol III pausing and premature termination of the RNA transcript. Rational mutation of one of the T-A pairs to a G-C pair in this portion of P1 has been shown to enhance sgRNA activity, suggesting this approach would also be feasible for PEgRNAs[195]. Additionally, increasing the length of P1 has also been shown to enhance sgRNA folding and lead to improved activity[195], suggesting it as another avenue for the improvement of PEgRNA activity. Example improvements to the core can include:

PEgRNA Containing a 6 nt Extension to P1

(SEQ ID NO: 228)
GGCCCAGACTGAGCACGTGAGTTTTAGAGCTAGCTCATGAAAATGAGCTAG

CAAGTTAAAATAAGGCTAGTCCGTTATCAACTTGAAAAAGTGGGACCGAGT

CGGTCCTCTGCCATCAAAGCGTGCTCAGTCTGTTTTTTT

PEgRNA Containing a T-A to G-C Mutation within P1

(SEQ ID NO: 229)
GGCCCAGACTGAGCACGTGAGTTTGAGAGCTAGAAATAGCAAGTTTAAATA

AGCTAGTCCGTTATCAACTTGAAAAAGTGGGACCGAGTCGGGTCCTCTGCC

ATCAAAGCGTGCTCAGTCTGTTTTTTT

In various other embodiments, the PEgRNA may be improved by introducing modifications to the edit template region. As the size of the insertion templated by the PEgRNA increases, it is more likely to be degraded by endonucleases, undergo spontaneous hydrolysis, or fold into secondary structures unable to be reverse-transcribed by the RT or that disrupt folding of the PEgRNA scaffold and subsequent Cas9-RT binding. Accordingly, it is likely that modification to the template of the PEgRNA might be necessary to affect large insertions, such as the insertion of whole genes. Some strategies to do so include the incorporation of modified nucleotides within a synthetic or semi-synthetic PEgRNA that render the RNA more resistant to degradation or hydrolysis or less likely to adopt inhibitory secondary structures[196]. Such modifications could include 8-aza-7-deazaguanosine, which would reduce RNA secondary structure in G-rich sequences; locked-nucleic acids (LNA) that reduce degradation and enhance certain kinds of RNA secondary structure; 2'-O-methyl, 2'-fluoro, or 2'-O-methoxyethoxy modifications that enhance RNA stability. Such modifications could also be included elsewhere in the PEgRNA to enhance stability and activity. Alternatively or additionally, the template of the PEgRNA could be designed such that it both encodes for a desired protein product and is also more likely to adopt simple secondary structures that are able to be unfolded by the RT. Such simple structures would act as a thermodynamic sink, making it less likely that more complicated structures that would prevent reverse transcription would occur. Finally, one could also split the template into two, separate PEgRNAs. In such a design, a PE would be used to initiate transcription and also recruit a separate template RNA to the targeted site via an RNA-binding protein fused to Cas9 or an RNA recognition element on the PEgRNA itself such as the MS2 aptamer. The RT could either directly bind to this separate template RNA, or initiate reverse transcription on the original PEgRNA before swapping to the second template. Such an approach could enable long insertions by both preventing misfolding of the PEgRNA upon addition of the long template and also by not requiring dissociation of Cas9 from the genome for long insertions to occur, which could possibly be inhibiting PE-based long insertions.

In still other embodiments, the PEgRNA may be improved by introducing additional RNA motifs at the 5' and 3' termini of the PEgRNAs, or even at positions therein between (e.g., in the gRNA core region, or the the spacer). Several such motifs—such as the PAN ENE from KSHV and the ENE from MALAT1 were discussed above as possible means to terminate expression of longer PEgRNAs from non-pol III promoters. These elements form RNA triple helices that engulf the polyA tail, resulting in their being retained within the nucleus[184,187]. However, by forming complex structures at the 3' terminus of the PEgRNA that occlude the terminal nucleotide, these structures would also likely help prevent exonuclease-mediated degradation of PEgRNAs.

Other structural elements inserted at the 3' terminus could also enhance RNA stability, albeit without enabling termination from non-pol III promoters. Such motifs could include hairpins or RNA quadruplexes that would occlude the 3' terminus[197], or self-cleaving ribozymes such as HDV that would result in the formation of a 2'-3'-cyclic phosphate at the 3' terminus and also potentially render the PEgRNA less likely to be degraded by exonucleases[198]. Inducing the PEgRNA to cyclize via incomplete splicing—to form a ciRNA—could also increase PEgRNA stability and result in the PEgRNA being retained within the nucleus[194].

Additional RNA motifs could also improve RT processivity or enhance PEgRNA activity by enhancing RT binding to the DNA-RNA duplex. Addition of the native sequence bound by the RT in its cognate retroviral genome could enhance RT activity[199]. This could include the native primer binding site (PBS), polypurine tract (PPT), or kissing loops involved in retroviral genome dimerization and initiation of transcription[199].

Addition of dimerization motifs—such as kissing loops or a GNRA tetraloop/tetraloop receptor pair[200]—at the 5' and 3' termini of the PEgRNA could also result in effective circularization of the PEgRNA, improving stability. Additionally, it is envisioned that addition of these motifs could enable the physical separation of the PEgRNA spacer and primer, prevention occlusion of the spacer which would hinder PE activity. Short 5' extensions or 3' extensions to the PEgRNA that form a small toehold hairpin in the spacer region or along the primer binding site could also compete favorably against the annealing of intracomplementary regions along the length of the PEgRNA, e.g., the interaction between the spacer and the primer binding site that can occur. Finally, kissing loops could also be used to recruit other template RNAs to the genomic site and enable swapping of RT activity from one RNA to the other. As exemplary embodiments of various secondary structures, the PEgRNA depicted in FIG. 3D and FIG. 3E list a number secondary RNA structures that may be engineered into any region of the PEgRNA, including in the terminal portions of the extension arm (i.e., eland e2), as shown.

Example improvements include, but are not limited to:
PEgRNA-HDV Fusion (SEQ ID NO: 230)
GGCCCAGACTGAGCACGTGAGTTTTAGAGCTAGAAATAGCAAGTTAAAATA

AGGCTAGTCCGTTATCAACTTGAAAAAGTGGGACCGAGTCGGTCCTCTGCC

ATCAAAGCGTGCTCAGTCTGGGCCGGCATGGTCCCAGCCTCCTCGCTGGCG

CCGGCTGGGCAACATGCTTCGGCATGGCGAATGGGACTTTTTTT

PEgRNA-MMLV Kissing Loop (SEQ ID NO: 231)
GGTGGGAGACGTCCCACCGGCCCAGACTGAGCACGTGAGTTTTAGAGCTAG

AAATAGCAAGTTAAAATAAGGCTAGTCCGTTATCAACTTGAAAAAGTGGGA

CCGAGTCGGTCCTCTGCCATCAAAGCTTCGACCGTGCTCAGTCTGGTGGGA

GACGTCCCACCTTTTTTT

PEgRNA-VS Ribozyme Kissing Loop (SEQ ID NO: 232)
GAGCAGCATGGCGTCGCTGCTCACGGCCCAGACTGAGCACGTGAGTTTTAG

AGCTAGAAATAGCAAGTTAAAATAAGGCTAGTCCGTTATCAACTTGAAAAA

GTGGGACCGAGTCGGTCCTCTGCCATCAAAGCTTCGACCGTGCTCAGTCTC

CATCAGTTGACACCCTGAGGTTTTTTT

PEgRNA-GNRA Tetraloop/Tetraloop Receptor (SEQ ID NO: 233)
GCAGACCTAAGTGGUGACATATGGTCTGGGCCCAGACTGAGCACGTGAGTT

TTAGAGCTAUACGTAGCAAGTTAAAATAAGGCTAGTCCGTTATCAACTTUA

CGAAGTGGGACCGAGTCGGTCCTCTGCCATCAAAGCTTCGACCGTGCTCAG

TCTGCATGCGATTAGAAATAATCGCATGTTTTTTT

PEgRNA Template Switching Secondary RNA-HDV Fusion (SEQ ID NO: 234)
TCTGCCATCAAAGCTGCGACCGTGCTCAGTCTGGTGGGAGACGTCCCACC

GGCCGGCATGGTCCCAGCCTCCTCGCTGGCGCCGGCTGGGCAACATGCTT

CGGCATGGCGAATGGGACTTTTTTT

PEgRNA scaffold could be further improved via directed evolution, in an analogous fashion to how SpCas9 and prime editor (PE) have been improved. Directed evolution could enhance PEgRNA recognition by Cas9 or evolved Cas9 variants. Additionally, it is likely that different PEgRNA scaffold sequences would be optimal at different genomic loci, either enhancing PE activity at the site in question, reducing off-target activities, or both. Finally, evolution of PEgRNA scaffolds to which other RNA motifs have been added would almost certainly improve the activity of the fused PEgRNA relative to the unevolved, fusion RNA. For instance, evolution of allosteric ribozymes composed of c-di-GMP-I aptamers and hammerhead ribozymes led to dramatically improved activity[202], suggesting that evolution would improve the activity of hammerhead-PEgRNA fusions as well. In addition, while Cas9 currently does not generally tolerate 5' extension of the sgRNA, directed evolution will likely generate enabling mutations that mitigate this intolerance, allowing additional RNA motifs to be utilized.

The present disclosure contemplates any such ways to further improve the efficacy of the prime editing systems disclosed here.

In various embodiments, it may be advantageous to limit the appearance of consecutive sequence of Ts from the extension arm as consecutive series of T's may limit the capacity of the PEgRNA to be transcribed. For example, strings of at least consecutive three T's, at least consecutive four T's, at least consecutive five T's, at least consecutive six T's, at least consecutive seven T's, at least consecutive eight T's, at least consecutive nine T's, at least consecutive ten T's, at least consecutive elevent T's, at least consecutive twelve T's, at least consecutive thirteen T's, at least consecutive fourteen T's, or at least consecutive fifteen T's should be avoided when designing the PEgRNA, or should be at least removed from the final designed sequence. In one embodiment, one can avoid the includes of unwanted strings of consecutive T's in PEgRNA extension arms but avoiding target sites that are rich in consecutive A:T nucleobase pairs.

Split PEgRNA Designs for Trans Prime Editing

The instant disclosure also contemplates trans prime editing, which refers to a modified version of prime editing which operates by separating the PEgRNA into two distinct molecules: a guide RNA and a tPERT molecule. The tPERT molecule is programmed to co-localize with the prime editor complex at a target DNA site, bringing the primer binding site and the DNA synthesis template to the prime editor in trans. For example, see FIG. 3G for an embodiment of a trans prime editor (tPE) which shows a two-component system comprising (1) an recruiting protein (RP)-PE:gRNA complex and (2) a tPERT that includes a primer binding site and a DNA synthesis template joined to an RNA-protein recruitment domain (e.g., stem loop or hairpin), wherein the recruiting protein component of the RP-PE:gRNA complex recruits the tPERT to a target site to be edited, thereby associating the PBS and DNA synthesis template with the prime editor in trans. Said another way, the tPERT is engineered to contain (all or part of) the extension arm of a PEgRNA, which includes the primer binding site and the DNA synthesis template. One advantage of this approach is to separate the extension arm of a PEgRNA from the guide RNA, thereby minimizing annealing interactions that tend to occur between the PBS of the extension arm and the spacer sequence of the guide RNA.

A key feature of trans prime editing is the ability of the trans prime editor to recruit the tPERT to the site of DNA editing, thereby effectively co-localizing all of the functions of a PEgRNA at the site of prime editing. Recruitment can be achieve by installing an RNA-protein recruitment domain, such as a MS2 aptamer, into the tPERT and fusing a corresponding recruiting protein to the prime editor (e.g., via a linker to the napDNAbp or via a linker to the polymerase) that is capable of specifically binding to the RNA-protein recruitment domain, thereby recruiting the tPERT molecule to the prime editor complex. As depicted in the process described in FIG. 3H, the RP-PE:gRNA complex binds to and nicks the target DNA sequence. Then, the recruiting protein (RP) recruits a tPERT to co-localize to the prime editor complex bound to the DNA target site, thereby allowing the primer binding site, located on the tPERT, to bind to the primer sequence on the nicked strand, and subsequently, allowing the polymerase (e.g., RT) to synthesize a single strand of DNA against the DNA synthesis template, located on the tPERT, up through the 5' end of the tPERT.

While the tPERT is shown in FIG. 3G and FIG. 3H as comprising the PBS and DNA synthesis template on the 5' end of the RNA-protein recruitment domain, the tPERT in other configurations may be designed with the PBS and DNA synthesis template located on the 3' end of the RNA-protein recruitment domain. However, the tPERT with the 5' extension has the advantage that synthesis of the single strand of DNA will naturally terminate at the 5' end of the tPERT and thus, does not risk using any portion of the RNA-protein recruitment domain as a template during the DNA synthesis stage of prime editing.

PEgRNA Design Method

The present disclosure also relates to methods for designing PEgRNAs.

In one aspect of design, the design approach can take into account the particular application for which prime editing is being used. For instance, and as exemplified and discussed herein, prime editing can be used, without limitation, to (a) install mutation-correcting changes to a nucleotide sequence, (b) install protein and RNA tags, (c) install immunoepitopes on proteins of interest, (d) install inducible dimerization domains in proteins, (e) install or remove sequences to alter that activity of a biomolecule, (f) install recombinase target sites to direct specific genetic changes, and (g) mutagenesis of a target sequence by using an error-prone RT. In addition to these methods which, in general, insert, change, or delete nucleotide sequences at target sites of interest, prime editors can also be used to construct highly programmable libraries, as well as to conduct cell data recording and lineage tracing studies. In these various uses, there may be as described herein particular design aspects pertaining to the preparation of a PEgRNA that is particularly useful for any given of these applications.

When designing a PEgRNA for any particular application or use of prime editing, a number of considerations may be taken into account, which include, but are not limited to:

(a) the target sequence, i.e., the nucleotide sequence in which one or more nucleobase modifications are desired to be installed by the prime editor;

(b) the location of the cut site within the target sequence, i.e., the specific nucleobase position at which the prime editor will induce a single-stand nick to create a 3' end RT primer sequence on one side of the nick and the 5' end endogenous flap on the other side of the nick (which ultimately is removed by FEN1 or equivalent thereto and replaced by the 3' ssDNA flap. The cut site is analogous to the "edit location" since this what creates the 3' end RT primer sequence which becomes extended by the RT during RNA-depending DNA polymerization to create the 3' ssDNA flap containing the desired edit, which then replaces the 5' endogenous DNA flap in the target sequence.

(c) the available PAM sequences (including the canonical SpCas9 PAM sites, as well as non-canonical PAM sites recognized by Cas9 variants and equivalents with expanded or differing PAM specificities);

(d) the spacing between the available PAM sequences and the location of the cut site in the target sequence;

(e) the particular Cas9, Cas9 variant, or Cas9 equivalent of the prime editor being used;

(f) the sequence and length of the primer binding site;

(g) the sequence and length of the edit template;

(h) the sequence and length of the homology arm;

(i) the spacer sequence and length; and (j) the core sequence.

The instant disclosure discusses these aspects above.

In one embodiment, an approach to designing a suitable PEgRNA, and optionally a nicking-sgRNA design guide for second-site nicking, is hereby provided. This embodiment provides a step-by-step set of instructions for designing PEgRNAs and nicking-sgRNAs for prime editing which takes into account one or more of the above considerations. The steps reference the examples shown in FIGS. 70A-70I.

1. Define the target sequence and the edit. Retrieve the sequence of the target DNA region (~200 bp) centered around the location of the desired edit (point mutation, insertion, deletion, or combination thereof). See FIG. 70A.
2. Locate target PAMs. Identify PAMs in the proximity to the desired edit location. PAMs can be identified on either strand of DNA proximal to the desired edit location. While PAMs close to the edit position are preferred (i.e., wherein the nick site is less than 30 nt from the edit position, or less than 29 nt, 28 nt, 27 nt, 26 nt, 25 nt, 24 nt, 23 nt, 22 nt, 21 nt, 20 nt, 19 nt, 18 nt, 17 nt, 16 nt, 15 nt, 14 nt, 13 nt, 12 nt, 11 nt, 10 nt, 9 nt, 8 nt, 7 nt, 6 nt, 5 nt, 4 nt, 3 nt, or 2 nt from the edit position to the nick site), it is possible to install edits using protospacers and PAMs that place the nick >30 nt from the edit position. See FIG. 70B.
3. Locate the nick sites. For each PAM being considered, identify the corresponding nick site and on which strand. For Sp Cas9 H840A nickase, cleavage occurs in the PAM-containing strand between the $3^{rd}$ and $4^{th}$ bases 5' to the NGG PAM. All edited nucleotides must exist 3' of the nick site, so appropriate PAMs must place the nick 5' to the target edit on the PAM-containing strand. In the example shown below, there are two possible PAMs. For simplicity, the remaining steps will demonstrate the design of a PEgRNA using PAM 1 only. See FIG. 70C.
4. Design the spacer sequence. The protospacer of Sp Cas9 corresponds to the 20 nucleotides 5' to the NGG PAM on the PAM-containing strand. Efficient Pol III transcription initiation requires a G to be the first transcribed nucleotide. If the first nucleotide of the protospacer is a G, the spacer sequence for the PEgRNA is simply the protospacer sequence. If the first nucleotide of the protospacer is not a G, the spacer sequence of the PEgRNA is G followed by the protospacer sequence. See FIG. 70D.
5. Design a primer binding site (PBS). Using the starting allele sequence, identify the DNA primer on the PAM-containing strand. The 3' end of the DNA primer is the nucleotide just upstream of the nick site (i.e. the $4^{th}$ base 5' to the NGG PAM for Sp Cas9). As a general design principle for use with PE2 and PE3, a PEgRNA primer binding site (PBS) containing 12 to 13 nucleotides of complementarity to the DNA primer can be used for sequences that contain ~40-60% GC content. For sequences with low GC content, longer (14- to 15-nt) PBSs should be tested. For sequences with higher GC content, shorter (8- to 11-nt) PBSs should be tested. Optimal PBS sequences should be determined empirically, regardless of GC content. To design a length-p PBS sequence, take the reverse complement of the first p nucleotides 5' of the nick site in the PAM-containing strand using the starting allele sequence. See FIG. 70E.
6. Design an RT template (or DNA synthesis template). The RT template (or DNA synthesis template where the polymerase is not reverse transcriptase) encodes the designed edit and homology to the sequence adjacent to the edit. In one embodiment, these regions correspond to the DNA synthesis template of FIG. 3D and FIG. 3E, wherein the DNA synthesis template comprises the "edit template" and the "homology arm." Optimal RT template lengths vary based on the target site. For short-range edits (positions +1 to +6), it is recommended to test a short (9 to 12 nt), a medium (13 to 16 nt), and a long (17 to 20 nt) RT template. For long-range edits (positions +7 and beyond), it is recommended to use RT templates that extend at least 5 nt (preferably 10 or more nt) past the position of the edit to allow for sufficient 3' DNA flap homology. For long-range edits, several RT templates should be screened to identify functional designs. For larger insertions and deletions (≥5 nt), incorporation of greater 3' homology (~20 nt or more) into the RT template is recommended. Editing efficiency is typically impaired when the RT template encodes the synthesis of a G as the last nucleotide in the reverse transcribed DNA product (corresponding to a C in the RT template of the PEgRNA). As many RT templates support efficient prime editing, avoidance of G as the final synthesized nucleotide is recommended when designing RT templates. To design a length-r RT template sequence, use the desired allele sequence and take the reverse complement of the first r nucleotides 3' of the nick site in the strand that originally contained the PAM. Note that compared to SNP edits, insertion or deletion edits using RT templates of the same length will not contain identical homology. See FIG. 70F.
7. Assemble the full PEgRNA sequence. Concatenate the PEgRNA components in the following order (5' to 3'): spacer, scaffold, RT template and PBS. See FIG. 70G.
8. Designing nicking-sgRNAs for PE3. Identify PAMs on the non-edited strand upstream and downstream of the edit. Optimal nicking positions are highly locus-dependent and should be determined empirically. In general, nicks placed 40 to 90 nucleotides 5' to the position across from the PEgRNA-induced nick lead to higher editing yields and fewer indels. A nicking sgRNA has a spacer sequence that matches the 20-nt protospacer in the starting allele, with the addition of a 5'-G if the protospacer does not begin with a G. See FIG. 70H.
9. Designing PE3b nicking-sgRNAs. If a PAM exists in the complementary strand and its corresponding protospacer overlaps with the sequence targeted for editing, this edit could be a candidate for the PE3b system. In the PE3b system, the spacer sequence of the nicking-sgRNA matches the sequence of the desired edited allele, but not the starting allele. The PE3b system operates efficiently when the edited nucleotide(s) falls within the seed region (~10 nt adjacent to the PAM) of the nicking-sgRNA protospacer. This prevents nicking of the complementary strand until after installation of the edited strand, preventing competition between the PEgRNA and the sgRNA for binding the target DNA. PE3b also avoids the generation of simultaneous nicks on both strands, thus reducing indel formation significantly while maintaining high editing efficiency. PE3b sgRNAs should have a spacer sequence that matches the 20-nt protospacer in the desired allele, with the addition of a 5' G if needed. See FIG. 70I.

The above step-by-step process for designing a suitable PEgRNA and a second-site nicking sgRNA is not meant to be limiting in any way. The disclosure contemplates variations of the above-described step-by-step process which would be derivable therefrom by a person of ordinary skill in the art.

[7] Applications Utilizing Prime Editing

In addition to the development of the prime editing system described herein as a new "search-and-replace" genome editing technology that mediates targeted insertions, deletions, and all 12 possible base-to-base conversions at targeted loci in human cells without requiring double-stranded DNA breaks, or donor DNA templates, the inventors have also contemplated the use of the prime editors in a wide-array of specific applications. For example, and as exemplified and discussed herein, prime editing can be used to (a) install mutation-correcting changes to a nucleotide sequence, (b) install protein and RNA tags, (c) intallation of immunoepitopes on proteins of interest, (d) install inducible dimerization domains in proteins, (e) install or remove sequences to alter that activity of a biomolecule, (f) install recombinase target sites to direct specific genetic changes, and (g) mutagenesis of a target sequence by using an error-prone RT. In addition to these methods which, in general, insert, change, or delete nucleotide sequences at target sites of interest, prime editors can also be used to construct highly programmable libraries, as well as to conduct cell data recording and lineage tracing studies. The inventors have also contemplated additional design features of PEgRNAs that are aimed to improve the efficacy of prime editing. Still further, the inventors have conceived of methods for successfully delivering prime editors using vector delivery systems and which involve splitting the napDNAbp using intein domains.

These specific exemplary uses of prime editing are in no way intended to be limiting. The present Application contemplates any use for prime editing which involves, in general, some form of the installation, removal, and/or modification of one or more nucleobases at a target site in a nucleotide sequence, e.g., a genomic DNA.

For any of the exemplified uses for prime editing, one may use any prime editor disclosed herein, including PE1, PE2, PE3, and PE3b, or PE-short.

A. Prime Editing Mechanism

In various embodiments, prime editing (or "prime editing") operates by contacting a target DNA molecule (for which a change in the nucleotide sequence is desired to be introduced) with a nucleic acid programmable DNA binding protein (napDNAbp) complexed with an extended guide RNA. In reference to FIG. 1G, the extended guide RNA comprises an extension at the 3' or 5' end of the guide RNA, or at an intramolecular location in the guide RNA and encodes the desired nucleotide change (e.g., single nucleotide change, insertion, or deletion). In step (a), the napDNAbp/extended gRNA complex contacts the DNA molecule and the extended gRNA guides the napDNAbp to bind to a target locus. In step (b), a nick in one of the strands of DNA of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence, i.e., the "non-target strand." The nick, however, could be introduced in either of the strands. That is, the nick could be introduced into the R-loop "target strand" (i.e., the strand hybridized to the protospacer sequence of the extended gRNA) or the "non-target strand" (i.e, the strand forming the single-stranded portion of the R-loop and which is complementary to the target strand). In step (c), the 3' end of the DNA strand (formed by the nick) interacts with the extended portion of the guide RNA in order to prime reverse transcription (i.e, "target-primed RT"). In certain embodiments, the 3' end DNA strand hybridizes to a specific RT priming sequence on the extended portion of the guide RNA, i.e, the "reverse transcriptase priming sequence." In step (d), a reverse transcriptase is introduced (as a fusion protein with the napDNAbp or in trans) which synthesizes a single strand of DNA from the 3' end of the primed site towards the 5' end of the extended guide RNA. This forms a single-strand DNA flap comprising the desired nucleotide change (e.g., the single base change, insertion, or deletion, or a combination thereof) and which is otherwise homologous to the endogenous DNA at or adjacent to the nick site. In step (e), the napDNAbp and guide RNA are released. Steps (f) and (g) relate to the resolution of the single strand DNA flap such that the desired nucleotide change becomes incorporated into the target locus. This process can be driven towards the desired product formation by removing the corresponding 5' endogenous DNA flap (e.g., by FEN1 or similar enzyme that is provide in trans, as a fusion with the prime editor, or endogenously provided) that forms once the 3' single strand DNA flap invades and hybridizes to the endogenous DNA sequence. Without being bound by theory, the cells endogenous DNA repair and replication processes resolves the mismatched DNA to incorporate the nucleotide change(s) to form the desired altered product. The process can also be driven towards product formation with "second strand nicking," as exemplified in FIG. 1G, or "temporal second strand nicking," as exemplified in FIG. 1I and discussed herein.

The process of prime editing may introduce at least one or more of the following genetic changes: transversions, transitions, deletions, and insertions. In addition, prime editing may be implemented for specific applications. For example, and as exemplied and discussed herein, prime editing can be used to (a) install mutation-correcting changes to a nucleotide sequence, (b) install protein and RNA tags, (c) intallation of immunoepitopes on proteins of interest, (d) install inducible dimerization domains in proteins, (e) install or remove sequences to alter that activity of a biomolecule, (f) install recombinase target sites to direct specific genetic changes, and (g) mutagenesis of a target sequence by using an error-prone RT. In addition to these methods which, in general, insert, change, or delete nucleotide sequences at target sites of interest, prime editors can also be used to construct highly programmable libraries, as well as to conduct cell data recording and lineage tracing studies. The inventors have also contemplated additional design features of PEgRNAs that are aimed to improve the efficacy of prime editing. Still further, the inventors have conceived of methods for successfully delivering prime editors using vector delivery systems and which involve splitting the napDNAbp using intein domains.

The term "prime editing system" or "prime editor (PE)" refers the compositions involved in the method of genome editing using target-primed reverse transcription (TPRT) describe herein, including, but not limited to the napDNAbps, reverse transcriptases, fusion proteins (e.g., comprising napDNAbps and reverse transcriptases), extended guide RNAs, and complexes comprising fusion proteins and extended guide RNAs, as well as accessory elements, such as second strand nicking components and 5' endogenous DNA flap removal endonucleases (e.g., FEN1) for helping to drive the prime editing process towards the edited product formation.

In another embodiment, the schematic of FIG. 3F depicts the interaction of a typical PEgRNA with a target site of a double stranded DNA and the concomitant production of a 3' single stranded DNA flap containing the genetic change of interest. The double strand DNA is shown with the top strand in the 3' to 5' orientation and the lower strand in the 5' to 3' direction. The top strand comprises the "protospacer" and the PAM sequence and is referred to as the "target strand." The complementary lower strand is referred to as the "non-target strand." Although not shown, the PEgRNA depicted would be complexed with a Cas9 or equivalent. As shown in the schematic, the spacer of the PEgRNA anneals to a complementary region on the target strand, which is referred to as the protospacer, which is located just downstream of the PAM sequence is approximately 20 nucleotides in length. This interaction forms as DNA/RNA hybrid between the spacer RNA and the protospacer DNA, and induces the formation of an R loop in the region opposite the protospacer. As taught elsewhere herein, the Cas9 protein (not shown) then induces a nick in the non-target strand, as shown. This then leads to the formation of the 3' ssDNA flap region which, in accordance with *z*, interacts with the 3' end of the PEgRNA at the primer binding site. The 3' end of the ssDNA flap (i.e., the reverse transcriptase primer sequence) anneals to the primer binding site (A) on the PEgRNA, thereby priming reverse transcriptase. Next, reverse transcriptase (e.g., provided in trans or provided cis as a fusion protein, attached to the Cas9 construct) then polymerizes a single strand of DNA which is coded for by the edit template (B) and homology arm (C). The polymerization continues towards the 5' end of the extension arm. The polymerized strand of ssDNA forms a ssDNA 3' end flap which, as describe elsewhere (e.g., as shown in FIG. 1G), invades the endogenous DNA, displacing the corresponding endogenous strand (which is removed as a 5' DNA flap of endogenous DNA), and installing the desired nucleotide edit (single nucleotide base pair change, deletions, insertions (including whole genes) through naturally occurring DNA repair/replication rounds.

This application of prime editing can be further described in Example 1.

B. Mutagenesis Using Prime Editing with Error-Prone RT

In various embodiments, the prime editing system (i.e., prime editing system) may include the use of an error-prone reverse transcriptase for performing targeted mutagenesis, i.e., to mutate only a well-defined stretch of DNA in a genome or other DNA element in a cell. FIG. 22 provides a schematic of an exemplary process for introducing conducting targeted mutagenesis with an error-prone reverse transcriptase on a target locus using a nucleic acid programmable DNA binding protein (napDNAbp) complexed with an extended guide RNA. This process may be referred to as an embodiment of prime editing for targeted mutagenesis. The extended guide RNA comprises an extension at the 3' or 5' end of the guide RNA, or at an intramolecular location in the guide RNA. In step (a), the napDNAbp/gRNA complex contacts the DNA molecule and the gRNA guides the napDNAbp to bind to the target locus to be mutagenized. In step (b), a nick in one of the strands of DNA of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence. In step (c), the 3' end DNA strand interacts with the extended portion of the guide RNA in order to prime reverse transcription. In certain embodiments, the 3' ended DNA strand hybridizes to a specific RT priming sequence on the extended portion of the guide RNA. In step (d), an error-prone reverse transcriptase is introduced which synthesizes a mutagenized single strand of DNA from the 3' end of the primed site towards the 3' end of the guide RNA. Exemplary mutations are indicated with an asterisk "*". This forms a single-strand DNA flap comprising the desired mutagenized region. In step (e), the napDNAbp and guide RNA are released. Steps (f) and (g) relate to the resolution of the single strand DNA flap (comprising the mutagenized region) such that the desired mutagenized region becomes incorporated into the target locus. This process can be driven towards the desired product formation by removing the corresponding 5' endogenous DNA flap that forms once the 3' single strand DNA flap invades and hybridizes to the complementary sequence on the other strand. The process can also be driven towards product formation with second strand nicking, as exemplified in FIG. 1F. Following endogenous DNA repair and/or replication processes, the mutagenized region becomes incorporated into both strands of DNA of the DNA locus.

This application of prime editing can be further described in Example 2.

Error-prone or mutagenic RT enzymes are known in the art. As used herein, the term "error-prone" reverse transcriptase refers to a reverse transcriptase enzyme that occurs naturally or which has been derived from another reverse transcriptase (e.g., a wild type M-MLV reverse transcriptase) which has an error rate that is less than the error rate of wild type M-MLV reverse transcriptase. The error rate of wild type M-MLV reverse transcriptase is reported to be in the range of one error in 15,000 to 27,000 nucleobase incorporations. See Boutabout et al. (2001) "DNA synthesis fidelity by the reverse transcriptase of the yeast retrotransposon Ty1," *Nucleic Acids Res* 29(11):2217-2222, which is incorporated herein by reference. Thus, for purposes of this application, the term "error prone" refers to those RT that have an error rate that is greater than one error in 15,000 nucleobase incorporation ($6.7 \times 10^{-5}$ or higher), e.g., 1 error in 14,000 nucleobases ($7.14 \times 10^{-5}$ or higher), 1 error in 13,000 nucleobases or fewer ($7.7 \times 10^{-5}$ or higher), 1 error in 12,000 nucleobases or fewer ($7.7 \times 10^{-5}$ or higher), 1 error in 11,000 nucleobases or fewer ($9.1 \times 10^{-5}$ or higher), 1 error in 10,000 nucleobases or fewer ($1 \times 10^{-4}$ or 0.0001 or higher), 1 error in 9,000 nucleobases or fewer (0.00011 or higher), 1 error in 8,000 nucleobases or fewer (0.00013 or higher) 1 error in 7,000 nucleobases or fewer (0.00014 or higher), 1 error in 6,000 nucleobases or fewer (0.00016 or higher), 1 error in 5,000 nucleobases or fewer (0.0002 or higher), 1 error in 4,000 nucleobases or fewer (0.00025 or higher), 1 error in 3,000 nucleobases or fewer (0.00033 or higher), 1 error in 2,000 nucleobase or fewer (0.00050 or higher), or 1 error in 1,000 nucleobases or fewer (0.001 or higher), or 1 error in 500 nucleobases or fewer (0.002 or higher), or 1 error in 250 nucleobases or fewer (0.004 or higher).

A variety of mutagenic RTs could be envisioned for generation of mutagenized sequences using prime editing. Two such examples are the mutagenic reverse transcriptases from *Bordetella* phage (see Handa, S., et al. *Nucl Acids Res* 9711-25 (2018), which is incorporated herein by reference) and *Legionella pneumophila* (see Arambula, D., et al. *Proc Natl Acad Sci USA* 8212-7 (2013), which is incorporated by reference). In the case of the RT from *Bordetella* phage (brt), an accessory protein might need to also be added (bavd) to Cas9—or delivered in trans—as well as additional RNA sequences to the PEgRNA to improve binding of the mutagenic RT to the target site (see Handa, S., et al. *Nucl Acids Res* 9711-25 (2018)). When using mutagenic RTs, the template region of the PEgRNA might be enriched in adenosines or AAY codons to enhance diversity.

The amino acid sequence of the mutagenic RT from *Bordetella* phage is provided as follows. Like other RTs disclosed herein, the Brt protein may be fused to a napD-NAbp as a fusion protein to form a functional PE.

| Name | Sequence |
|---|---|
| brt mutagenic rt | MGKRHRNLIDQITTWENLLDAYRKTSHGKRRTWGYLEFKEYDL ANLLALQAELKAGNYERGPYREFLVYEPKPRLISALEFKDRLV QHALCNIVAPIFEAGLLPYTYACRPDKGTHAGVCHVQAELRRT RATHFLKSDFSKFFPSIDRAALYAMIDKKIHCAATRRLLRVVL PDEGVGIPIGSLTSQLFANVYGGAVDRLLHDELKQRHWARYMD DIVVLGDDPEELRAVFYRLRDFASERLGLKISHWQVAPVSRGI NFLGYRIWPTHKLLRKSSVKRAKRKVANFIKHGEDESLQRFLA SWSGHAQWADTHNLFTWMEEQYGIACH (SEQ ID NO: 235) |

In the case of Brt from Bodetella, the PE fusion may also include an additional accessory protein (Bavd). The accessory protein may be fused to the PE fusion protein or provided in trans. The amino acid sequence of Bavd accessory protein is provided as follows:

| Name | Sequence |
|---|---|
| bavd accessory protein to brt | MEPIEEATKCYDQMLIVERYERVISYLYPIAQSIPRKHGV AREMFLKCLLGQVELFIVAGKSNQVSKLYAADAGLAMLRF WLRFLAGIQKPHAMTPHQVETAQVLIAEVGRILGSWIARV NRKGQAGK (SEQ ID NO: 236) |

In the case of Brt from Bodetella, the PEgRNA may comprise an additional nucleotide sequence added a PEgRNA, e.g., to the 5' or 3' end. Exemplary sequence is as follows, which is originally from the *Bordetella* phage genome:

| NAME | SEQUENCE |
|---|---|
| PEGRNA-ADDITION 1 | ACCUUCUUGCAUGGCUCUGCCAACGCUACGGCUUGGCGGGC UGGCCUUUCCUCAAUAGGUGGUCAGCCGGUUCUGUCCUGCU UCGGCGAACACGUUACACGGUUCGGCAAAACGUCGAUUACU GAAAAUGGAAAGGCGGGGCCGACUUCAAGGGCAGGCUGGGA AAUAA (SEQ ID NO: 237) |

This PEgRNA addition sequence can be reduced in various ways to shorten the length. For example, the PEgRNA-addition 1 sequence could be reduced to the following exemplary alternative addition sequences:

| NAME | SEQUENCE |
|---|---|
| PEGRNA-ADDITION 2 | ACCUUCUUGCAUGGCUCUGCCAACGCUACGGCUUGGCGG GCUGGCCUUUCCUCAAUAGGUGGUCAGCCGGUUCUGUCC UGCUUCGGCGAACACGUUACACGGUUCGGCAAAACGUCG AUUACUGAAAAUGGAAAGGCGGGGCCGACUUC (SEQ ID NO: 238) |
| PEGRNA-ADDITION 3 | ACCUUCUUGCAUGGCUCUGCCAACGCUACGGCUUGGCGG GCUGGCCUUUCCUCAAUAGGUGGUCAAAGGGCAGGCUGG GAAAUAA (SEQ ID NO: 239) |
| PEGRNA-ADDITION 4 | ACCUUCUUGCAUGGCUCUGCCAACGCUACGGCUUGGCGG GCUGGCCUUUCCUCAAUAGGUGGUCA (SEQ ID NO: 277) |
| PEGRNA-ADDITION 5 | CAUGGCUCUGCCAACGCUACGGCUUGGCGGGCUGGCCUU UCCUCAAUAGGUGGUCAGCCGGUUCUGUCCUGCUUCGGC GAACACGUUACACGGUUCGGCAAAACGUCGAUUACUGAA AAUGGAAAGGCGGGGCCGACUUCAAGGGCAGGCUGGGAA AUAA (SEQ ID NO: 240) |
| PEGRNA-ADDITION 6 | CAUGGCUCUGCCAACGCUACGGCUUGGCGGGCUGGCCUU UCCUCAAUAGGUGGUCAGCCGGUUCUGUCCUGCUUCGGC GAACACGUUACACGGUUCGGCAAAACGUCGAUUACUGAA AAUGGAAAGGCGGGGCCGACUUC (SEQ ID NO: 241) |
| PEGRNA-ADDITION 7 | CAUGGCUCUGCCAACGCUACGGCUUGGCGGGCUGGCCUU UCCUCAAUAGGUGGUCAAAGGGCAGGCUGGGAAAUAA (SEQ ID NO: 242) |
| PEGRNA-ADDITION 8 | CAUGGCUCUGCCAACGCUACGGCUUGGCGGGCUGGCCUU UCCUCAAUAGGUGGUCA (SEQ ID NO: 243) |

In other embodiments, the PEgRNA addition sequence can be also be mutated. For example, the PEgRNA-addition 1 sequence could be mutated to the following exemplary alternative addition sequence:

| NAME | SEQUENCE |
|---|---|
| PEGRNA-ADDITION 1 MUTATED | ACCUUCUUGCAUGGCUCUGCCAACGCUACGGCUUGGCGG GCUGGCCUUUCCUCAAUAGAUGAGCCGCCGGUUCUGUCC UGCUUCGGCGAACACGUUACACGGUUCGGCAAAACGUCG AUUACUGAAAAUGGAAAGGCGGGGCCGACUUCAAGGGCA GGCUGGGAAAUAA (SEQ ID NO: 244) |

In various embodiments relating to the use of PE for introducing mutations, special PEgRNA considerations may apply. For example, without wishing to be bound by theory, the additional PEgRNA sequences described above might be needed to enable efficient mutagenesis via mutagenic RTs.

Any mutagenic RT may be used with the prime editors disclosed herein. For example, the error-prone RT described in the following references may be used and are incorporated herein by reference:

Bebenek et al., "Error-prone polymerization by HIV-1 reverse transcriptase. Contribution of template-primer misalignment, miscoding, and termination probability to mutational hot spots.," *J. Biol Chem*, 1993, 268: 10324-34; and Menendez-Arias, "Mutation rates and instrinsic fidelity of retroviral reverse transcriptases," 2009, *Viruses*, 1(3): 1137-1165.

Various error-prone RTs can include, but are not limited to, the following enzymes disclosed in Table 1 of Menendez-Arias et al. (the entire contents of the reference of which are incorporated by reference), as follows:

| ERROR-PRONE RT | REPORTED ERROR-RATE RANGE |
|---|---|
| HIV-1 RT (GROUP M, SUBTYPE B) | $0.6 \times 10^{-4}$ TO $2.0 \times 10^{-4}$ |
| HIV-1 RT (GROUP O) | $5.5 \times 10^{-5}$ |
| SIV AGM RT | $2.9 \times 10^{-5}$ |
| SIV MNE RT | $1.6 \times 10^{-5}$ TO $1.2 \times 10^{-4}$ |
| PFV RT | $1.7 \times 10^{-4}$ |
| FIV RT | $6.2 \times 10^{-5}$ |
| AMV RT | $5.9 \times 10^{-5}$ |
| MO-MLV RT | $2.7 \times 10^{-5}$ TO $3.3 \times 10^{-5}$ |

C. Use of Prime Editing for Treating Triplet Expansion Disorders

The prime editing system or prime editing (PE) system described herein may be used to contract trinucleotide repeat mutations (or "triplet expansion diseases") to treating conditions such as Huntington's disease and other trinucleotide repeat disorders. Trinucleotide repeat expansion disorders are complex, progressive disorders that involve developmental neurobiology and often affect cognition as well as sensori-motor functions. The disorders show genetic anticipation (i.e. increased severity with each generation). The DNA expansions or contractions usually happen meiotically (i.e. during the time of gametogenesis, or early in embryonic development), and often have sex-bias meaning that some genes expand only when inherited through the female, others only through the male. In humans, trinucleotide repeat expansion disorders can cause gene silencing at either the transcriptional or translational level, which essentially knocks out gene function. Alternatively, trinucleotide repeat expansion disorders can cause altered proteins generated with large repetitive amino acid sequences that either abrogate or change protein function, often in a dominant-negative manner (e.g. poly-glutamine diseases).

Without wishing to be bound by theory, triplet expansion is caused by slippage during DNA replication or during DNA repair synthesis. Because the tandem repeats have identical sequence to one another, base pairing between two DNA strands can take place at multiple points along the sequence. This may lead to the formation of "loop out" structures during DNA replication or DNA repair synthesis. This may lead to repeated copying of the repeated sequence, expanding the number of repeats. Additional mechanisms involving hybrid RNA:DNA intermediates have been proposed. Prime editing may be used to reduce or eliminate these triplet expansion regions by deletion one or more or the offending repeat codon triplets. In an embodiment of this use, FIG. 23, provides a schematic of a PEgRNA design for contracting or reducing trinucleotide repeat sequences with prime editing.

Prime editing may be implemented to contract triplet expansion regions by nicking a region upstream of the triplet repeat region with the prime editor comprising a PEgRNA appropriated targeted to the cut site. The prime editor then synthesizes a new DNA strand (ssDNA flap) based on the PEgRNA as a template (i.e., the edit template thereof) that codes for a healthy number of triplet repeats (which depends on the particular gene and disease). The newly synthesized ssDNA strand comprising the healthy triplet repeat sequence also is synthesized to include a short stretch of homology (i.e., the homology arm) that matches the sequence adjacent to the other end of the repeat (red strand). Invasion of the newly synthesized strand, and subsequent replacement of the endogenous DNA with the newly synthesized ssDNA flap, leads to a contracted repeat allele.

Depending on the particular trinucleotide expansion disorder, the defect-inducing triplet expansions may occur in "trinucleotide repeat expansion proteins." Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders can be selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non-limiting examples of proteins associated with trinucleotide repeat expansion disorders which can be corrected by prime editing include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN8OS (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L1 (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3 (canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L14), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C10orf2 (chromosome 10 open reading frame 2), MAML3 mastermind-like 3 (*Drosophila*), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SP1 (Sp1 transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDA1 (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox A1), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

The prime editors herein disclosed may be used to contract triplet repeat expansion regions in any of the above-indicated disease proteins, including following polyglutamine triplet expansion disease genes (which show the particular location of the pathogenic repeats that may be removed wholly or in part by prime editing):

| TRIPLET EXPANSION DISEASE | AFFECTED GENE | POSITION OF PATHOGENIC REPEATS |
|---|---|---|
| DENTATORUBROPALLIDOLUYSIAN ATROPHY | ATN1 ATROPHIN-1 | 49-88 |
| HUNTINGTON'S DISEASE | HTT THE HUNTINGTIN GENE | 36-250 |
| SPINAL AND BULBAR MUSCULAR ATROPHY | AR ANDROGEN RECEPTOR | 38-62 |
| SPINOCEREBELLAR ATAXIA TYPE 1 | ATXN1 ATAXIN 1 | 49-88 |
| SPINOCEREBELLAR ATAXIA TYPE 2 | ATXN2 ATAXIN 2 | 33-77 |
| SPINOCEREBELLAR ATAXIA TYPE 3 | ATXN3 ATAXIN 3 | 55-86 |
| SPINOCEREBELLAR ATAXIA TYPE 6 | CACNA1A | 21-30 |
| SPINOCEREBELLAR ATAXIA TYPE 7 | ATXN7 ATAXIN 7 | 38-120 |
| SPINOCEREBELLAR ATAXIA TYPE 17 | TBP TATA-BINDING PROTEIN | 47-63 |

The prime editors herein disclosed may also be used to contract triplet repeat expansion regions typically found in the following non-polyglutamine triplet expansion disease genes:

| TRIPLET EXPANSION DISEASE | AFFECTED GENE | POSITION OF PATHOGENIC REPEATS |
|---|---|---|
| FRAXA (FRAGILE X SYNDROME) | FMR1 FRAGILE X MENTAL RETARDATION PROTEIN | 230+ |
| FXTAS (FRAGILE X-ASSOCIATED TREMOR/ATAXIA SYNDROME) | FMR1 | 55-200 |
| FRAXE (FRAGILE XE MENTAL RETARDATION) | AFF2 | 200+ |
| FRDA (FRIEDREICH'S ATAXIA) | FXN FRATAXIN | 100+ |
| DM1 (MYOTONIC DYSTROPHY TYPE 1) | DMPK MYOTONIN-PROTEIN KINASE | 50+ |
| SCA8 (SPINOCEREBELLAR ATAXIA TYPE 8) | SCA8 ATAXIN 8 | 110-250 |
| SCA12 (SPINOCEREBELLAR ATAXIA TYPE 12) | PPP2R2B SERINE/THREONIN PROTEIN PHOSPHATASE 2A | 66-78 |

Prime editing may be implemented to contract triplet expansion regions using a PEgRNA with an edit template that is designed to delete at least one codon of a triplet expansion region. In other embodiments, the PEgRNAs for using in prime editing for this used to delete at least 1, or 2, or 3, or 4, or 5, or 6, or 7, or 8, or 9, or 10, or 11, or 12, or 13, or 14, or 15, or 16, or 17, or 18, or 19, or 20, or 21, or 22, or 23, or 24, or 25, or 26, or 27, or 28, or 29, or 30, or 31, or 32, or 33, or 34, or 35, or 36, or 37, or 38, or 39, or 40, or 41, or 42, or 43, or 44, or 45, or 46, or 47, or 48, or 49, or 50, or 51, or 52, or 53, or 54, or 55, or 56, or 57, or 58, or 59, or 60, or 61, or 62, or 63, or 64, or 65, or 66, or 67, or 68, or 69, or 70, or 71, or 72, or 73, or 74, or 75, or 76, or 77, or 78, or 79, or 80, or 81, or 82, or 83, or 84, or 85, or 86, or 87, or 88, or 89, or 90, or 91, or 92, or 93, or 94, or 95, or 96, or 97, or 98, or 99, or 100, or more codons from a triplet expansion region in order to arrive at a healthy (i.e., not associated with producing the disease) number of triplet repeats.

In other embodiments, the PEgRNAs for using in prime editing for this used to delete at least 1, or 2, or 3, or 4, or 5, or 6, or 7, or 8, or 9, or 10, or 11, or 12, or 13, or 14, or 15, or 16, or 17, or 18, or 19, or 20 or more codons from a triplet expansion region in order to arrive at a healthy (i.e., not associated with producing the disease) number of triplet repeats.

In other embodiments, the the PEgRNAs for using in prime editing for this used to delete at least 1, or 2, or 3, or 4, or 5, or 6, or 7, or 8, or 9, or 10, or 11, or 12, or 13, or 14, or 15, or more codons from a triplet expansion region in order to arrive at a healthy (i.e., not associated with producing the disease) number of triplet repeats.

In other embodiments, the PEgRNAs for using in prime editing for this used to delete at least 1, or 2, or 3, or 4, or 5, or 6, or 7, or 8, or 9, or 10, or more codons from a triplet expansion region in order to arrive at a healthy (i.e., not associated with producing the disease) number of triplet repeats.

Prime editing may be configured to correct any triplet expansion region, such as those described in Budworth et al., "A Brief History of Triplet Repeat Diseases," *Methods Mol Biol*, 2013, 1010: 3-17, US 20011/00165540 A1 (Genome editing of genes associated with trinucleotide repeat expansion disorders in animals), US 2016/0355796 A1 (Compositions and methods of use of crispr-cas systems in nucleotide repeat disorders In various embodiments, the disclosure provides a prime editing construct suitable for use in a cell having a trinucleotide repeat expansion region in a defective gene comprising (a) a prime editor fusion comprising a napDNAbp and a reverse transcriptase, (b) a PEgRNA comprising a spacer sequence that targets the trinucleotide repeat expansion region and an extension arm comprising an edit template that codes for the removal of the trinucleotide repeat expansion region.

In various other embodiments, the disclosure provides a method for deleting all or a portion of a trinucleotide repeat expansion region in a defective gene in a cell using prime editing comprising contacting the cell with a prime editor fusion comprising a napDNAbp and a reverse transcriptase and a PEgRNA comprising a spacer sequence that targets the trinucleotide repeat expansion region and an extension arm comprising an edit template that codes for the removal of the trinucleotide repeat expansion region.

In various embodiments, the trinucleotide repeat comprises repeating CTG, CAG, CGG, CCG, GAA, or TTC trinucleotides.

In various other embodiments, the tetranucleotide repeats, pentanucleotide repeats, or hexanucleotide repeats.

D. Use of Prime Editing for Peptide Tagging

In another aspect, the disclosure provides a method of using the herein described prime editors for genetically grafting one or more peptide tags onto a protein using prime editing, More in particular, the disclosure provides a method for genetically installing one or more peptide tags onto a protein comprising: contacting a target nucleotide sequence encoding the protein with a prime editor configured to insert therein a second nucleotide sequence encoding the one or more peptide tags to result in a recombinant nucleotide sequence that encodes a fusion protein comprising the protein fused to the protein tag.

In other embodiments, the disclosure provides a method for making a fusion protein comprising a peptide of interest and one or more peptide tags, the method comprising: contacting a target nucleotide sequence encoding the protein with a prime editor configured to insert therein a second nucleotide sequence encoding the one or more peptide tags to result in a recombinant nucleotide sequence that encodes the fusion protein comprising the protein fused to the protein tag.

In various embodiments, the target nucleotide sequence is a specific gene of interest in a genomic DNA. The gene of interest may encode a protein of interest (e.g., a receptor, an enzyme, a therapeutic protein, a membrane protein, a transport protein, a signal transduction protein, or an immunological protein, etc.). The gene of interest may also encode an RNA molecule, including, but not limited to, messenger RNA (mRNA), transfer RNA (tRNA), ribosomal RNA (rRNA), small nuclear RNA (snRNA), antisense RNA, guide RNA, microRNA (miRNA), small interfering RNA (siRNA), and cell-free RNA (cfRNA).

The peptide tag may be any peptide tag or variant thereof which imparts one or more functions onto a protein for purposes such as separation, purification, visualization, solubilization, or detection. The peptides tags can include "affinity tags" (to facilitate protein purification), "solubilization tags" (to assist in proper folding of proteins), "chromatography tags" (to alter chromatographic properties of proteins), "epitope tags" (to bind to high affinity antibodies), and "fluorescence tags" (to facilitate visualization of proteins in a cell or in vitro). Examples of peptide tags include, but are not limited to the following tags:

| NAME | AMINO ACID SEQUENCE | SEQ ID NO: |
|---|---|---|
| AVITAG™ | GLNDIFEAQKIEWHE | SEQ ID NO: 245 |
| C-TAG | EPEA | SEQ ID NO: 246 |
| CALMODULIN-TAG | KRRWKKNFIAVSAANRFKKISSSGAL | SEQ ID NO: 247 |
| POLY-GLUTAMATE TAG | EEEEEE | SEQ ID NO: 248 |
| E-TAG | GAPVPYPDPLEPR | SEQ ID NO: 249 |
| FLAG-TAG | DYKDDDDK | SEQ ID NO: 250 |
| HA-TAG | YPYDVPDYA | SEQ ID NO: 251 |
| HIS-TAG | H ($HIS_1$)<br>HH ($HIS_2$)<br>HHH ($HIS_3$)<br>HHHH ($HIS_4$)<br>HHHHH ($HIS_5$)<br>HHHHHH ($HIS_6$)<br>HHHHHHH ($HIS_7$)<br>HHHHHHHH ($HIS_8$)<br>HHHHHHHHH ($HIS_9$)<br>HHHHHHHHHH ($HIS_{10}$)<br>HHHHHHHHH...H... ($HIS_N$, WHEREIN N = 1-25) | SEQ ID NO: 252<br>SEQ ID NO: 253<br>SEQ ID NO: 254<br>SEQ ID NO: 255<br>SEQ ID NO: 256<br>SEQ ID NO: 257<br>SEQ ID NO: 258<br>SEQ ID NO: 259<br>SEQ ID NO: 260<br>SEQ ID NO: 261<br>SEQ ID NO: 262 |
| MYC-TAG | EQKLISEEDL | SEQ ID NO: 263 |
| NE-TAG | TKENPRSNQEESYDDNES | SEQ ID NO: 264 |
| RHO1D4-TAG | TETSQVAPA | SEQ ID NO: 265 |
| S-TAG | KETAAAKFERQHMDS | SEQ ID NO: 266 |
| SBP-TAG | MDEKTTGWRGGHVVEGLAGELEQLRARLEHHPQGQREP | SEQ ID NO: 267 |
| SOFTAG-1 | SLAELLNAGLGGS | SEQ ID NO: 268 |
| SOFTAG-2 | TQDPSRVG | SEQ ID NO: 269 |
| SPOT-TAG | PDRVRAVSHWSS | SEQ ID NO: 270 |
| STREP-TAG | WSHPQFEK | SEQ ID NO: 271 |
| TC TAG | CCPGCC | SEQ ID NO: 272 |
| TY TAG | EVHTNQDPLD | SEQ ID NO: 273 |
| V5 TAG | GKPIPNPLLGLDST | SEQ ID NO: 274 |
| VSV-TAG | YTDIEMNRLGK | SEQ ID NO: 275 |
| XPRESS TAG | DLYDDDDK | SEQ ID NO: 276 |

Peptide tags may also be the following affinity tags (for separation and/or purification of proteins) (as described in Table 9.9.1 of Kimple et al., "Overview of Affinity Tags for Protein Purification," *Curr Protoc Protein Sci,* 2013, 73:Unit-9.9, which is incorporated herein by reference).

| NAME | AMINO ACID SEQUENCE | |
|---|---|---|
| AU1 EPITOPE | DTYRYI | SEQ ID NO: 278 |
| AU5 EPITOPE | TDFYLK | SEQ ID NO: 279 |
| BACTERIOPHAGE T7 EPITOPE (T7-TAG) | MASMTGGQQMG | SEQ ID NO: 280 |
| BLUETONGUE VIRUS TAG (B-TAG) | QYPALT | SEQ ID NO: 281 |
| E2 EPITOPE | SSTSSDFRDR | SEQ ID NO: 282 |
| HISTIDINE AFFINITY TAG (HAT) | KDHLIHNVHKEFHAHAHNK | SEQ ID NO: 283 |
| HSV EPITOPE | QPELAPED | SEQ ID NO: 284 |
| POLYARGININE (ARG-TAG) | RRRRR | SEQ ID NO: 285 |
| POLYASPARTATE (ASP-TAG) | CCCC | SEQ ID NO: 286 |
| POLY-PHENYLALANINE (PHE-TAG) | FFFFFFFFFF | SEQ ID NO: 287 |
| S1-TAG | NANNPDWDF | SEQ ID NO: 288 |
| S-TAG | KETAAAKFERQHMDS | SEQ ID NO: 289 |
| VSV-G | YTDIEMNRLGK | SEQ ID NO: 290 |

In particular embodiments, the peptide tags may include a $His^6$ tag, FLAG-tag, V5-tag, GCN4-tag, HA-tag, Myc-Tag, FlAsH/ReAsH-tag, Sortase substrate, pi-clamp.

In various embodiments, the peptide tags may be used for applications that include protein fluorescent labeling, immunoprecipitation, immunoblotting, immunohistochemistry, protein recruitment, inducible protein degrons, and genome-wide screening.

In various other embodiments, the peptide tag may include an intein sequence to install protein self-splicing function. As used herein, the term "intein" refers to auto-processing polypeptide domains found in organisms from all domains of life. An intein (intervening protein) carries out a unique auto-processing event known as protein splicing in which it excises itself out from a larger precursor polypeptide through the cleavage of two peptide bonds and, in the process, ligates the flanking extein (external protein) sequences through the formation of a new peptide bond. This rearrangement occurs post-translationally (or possibly co-translationally), as intein genes are found embedded in frame within other protein-coding genes. Furthermore, intein-mediated protein splicing is spontaneous; it requires no external factor or energy source, only the folding of the intein domain. This process is also known as cis-protein splicing, as opposed to the natural process of trans-protein splicing with "split inteins." Inteins are the protein equivalent of the self-splicing RNA introns (see Perler et al., Nucleic Acids Res. 22:1125-1127 (1994)), which catalyze their own excision from a precursor protein with the concomitant fusion of the flanking protein sequences, known as exteins (reviewed in Perler et al., Curr. Opin. Chem. Biol. 1:292-299 (1997); Perler, F. B. Cell 92(1):1-4 (1998); Xu et al., EMBO J. 15(19):5146-5153 (1996)).

The mechanism of the protein splicing process has been studied in great detail (Chong, et al., J. Biol. Chem. 1996, 271, 22159-22168; Xu, M-Q & Perler, F. B. EMBO Journal, 1996, 15, 5146-5153) and conserved amino acids have been found at the intein and extein splicing points (Xu, et al., EMBO Journal, 1994, 13 5517-522).

Inteins can also exist as two fragments encoded by two separately transcribed and translated genes. These so-called split inteins self-associate and catalyze protein-splicing activity in trans. Split inteins have been identified in diverse cyanobacteria and archaea (Caspi et al, Mol Microbiol. 50: 1569-1577 (2003); Choi J. et al, J Mol Biol. 556: 1093-1106 (2006.); Dassa B. et al, Biochemistry. 46:322-330 (2007.); Liu X. and Yang J., J Biol Chem. 275:26315-26318 (2003); Wu H. et al. Proc Natl Acad Sci USA. £5:9226-9231 (1998.); and Zettler J. et al, FEBS Letters. 553:909-914 (2009)), but have not been found in eukaryotes thus far. Recently, a bioinformatic analysis of environmental metagenomic data revealed 26 different loci with a novel genomic arrangement. At each locus, a conserved enzyme coding region is interrupted by a split intein, with a freestanding endonuclease gene inserted between the sections coding for intein subdomains. Among them, five loci were completely assembled: DNA helicases (gp41-1, gp41-8); Inosine-5'-monophosphate dehydrogenase (IMPDH-1); and Ribonucleotide reductase catalytic subunits (NrdA-2 and NrdJ-1). This fractured gene organization appears to be present mainly in phages (Dassa et al, Nucleic Acids Research. 57:2560-2573 (2009)).

In certain embodiments, the prime editors described herein can be used to insert split-intein tags in two different proteins, causing their intracellular ligation when co-expressed to form a fusion protein. In protein trans-splicing, one precursor protein consists of an N-extein part followed by the N-intein, another precursor protein consists of the C-intein followed by a C-extein part, and a trans-splicing reaction (catalyzed by the N- and C-inteins together) excises the two intein sequences and links the two extein sequences with a peptide bond. Protein trans-splicing, being an enzymatic reaction, can work with very low (e.g., micromolar) concentrations of proteins and can be carried out under physiological conditions.

The split intein Npu DnaE was characterized as having the highest rate reported for the protein trans-splicing reaction. In addition, the Npu DnaE protein splicing reaction is considered robust and high-yielding with respect to different extein sequences, temperatures from 6 to 37° C., and the presence of up to 6M Urea (Zettler J. et al, FEBS Letters. 553:909-914 (2009); Iwai I. et al, FEBS Letters 550: 1853-1858 (2006)). As expected, when the Cys1 Ala mutation at the N-domain of these inteins was introduced, the initial N to S-acyl shift and therefore protein splicing was blocked. Unfortunately, the C-terminal cleavage reaction was also almost completely inhibited. The dependence of the asparagine cyclization at the C-terminal splice junction on the acyl shift at the N-terminal scissile peptide bond seems to be a unique property common to the naturally split DnaE intein alleles (Zettler J. et al. FEBS Letters. 555:909-914 (2009)).

Protein trans-splicing, catalyzed by split inteins, provides an entirely enzymatic method for protein ligation. A split-intein is essentially a contiguous intein (e.g. a mini-intein) split into two pieces named N-intein and C-intein, respectively. The N-intein and C-intein of a split intein can associate non-covalently to form an active intein and catalyze the splicing reaction essentially in same way as a contiguous intein does. Split inteins have been found in nature and also engineered in laboratories. As used herein, the term "split intein" refers to any intein in which one or more peptide bond breaks exists between the N-terminal and C-terminal amino acid sequences such that the N-terminal and C-terminal sequences become separate molecules that can non-covalently reassociate, or reconstitute, into an intein that is functional for trans-splicing reactions. Any catalytically active intein, or fragment thereof, may be used to derive a split intein for use in the methods of the invention. For example, in one aspect the split intein may be derived from a eukaryotic intein. In another aspect, the split intein may be derived from a bacterial intein. In another aspect, the split intein may be derived from an archaeal intein. Preferably, the split intein so-derived will possess only the amino acid sequences essential for catalyzing trans-splicing reactions.

Split inteins may be created from contiguous inteins by engineering one or more split sites in the unstructured loop or intervening amino acid sequence between the −12 conserved beta-strands found in the structure of mini-inteins. Some flexibility in the position of the split site within regions between the beta-strands may exist, provided that creation of the split will not disrupt the structure of the intein, the structured beta-strands in particular, to a sufficient degree that protein splicing activity is lost.

The prime editors described herein may incorporate peptide tags (including inteins) into the C-terminal end of a protein of interest. In other embodiments, the peptide tags (including inteins) may be incorporated into the N-terminal end of a protein of interest. The peptide tags may also be incorporated into the interior of a protein of interest. The resulting fusion proteins created by the herein described prime editors may have the following structures:

[protein of interest]-[peptide tag];
[peptide tag]-[protein of interest]; or
[protein of interest-N-terminal region]-[peptide tag]-[protein of interest-C-terminal region].

The principles of guide RNA design for use in peptide tagging throughout may be applied to peptide tagging. For example, in one embodiment, the PEgRNA structure for peptide tagging may have the following structure: 5'-[spacer sequence]-[gRNA core or scaffold]-[extension arm]-3', wherein the extension arm comprises in the 5' to 3' direction, a homology arm, edit template (comprising the sequence that encodes the peptide tag), and a primer binding site. This configuration is depicted in FIG. 3D and in FIG. 24.

In another embodiment, the PEgRNA structure for peptide tagging may have the following structure: 5'-[extension arm]-[spacer sequence]-[gRNA core or scaffold]-3', wherein the extension arm comprises in the 5' to 3' direction, a homology arm, edit template (comprising the sequence that encodes the peptide tag), and a primer binding site. This configuration is depicted in FIG. 3E.

Embodiments of peptide tagging using prime editing is depicted in FIGS. 25 and 26 and described in Example 4.

E. Use of Prime Editing for Preventing or Treating Prion Disease

Prime editing can also be used to prevent or halt the progression of prion disease through the installation of one or more protective mutations into prion proteins (PRNP) which become misfolded during the course of disease. Prion diseases or transmissible spongiform encephalopathies (TSEs) are a family of rare progressive neurodegenerative disorders that affect both humans and animals. They are distinguished by long incubation periods, characteristic spongiform changes associated with neuronal loss, and a failure to induce inflammatory response.

In humans, prion disease includes Creutzfeldt-Jakob Disease (CJD), Variant Creutzfeldt-Jakob Disease (vCJD), Gerstmann-Straussler-Scheinker Syndrome, Fatal Familial Insomnia, and Kuru. In animals, prion disease includes Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy. Prime editing may be used to install protective point mutations into a prion protein in order to prevent or halt the progression of any one of these prion diseases.

Classic CJD is a human prion disease. It is a neurodegenerative disorder with characteristic clinical and diagnostic features. This disease is rapidly progressive and always fatal. Infection with this disease leads to death usually within 1 year of onset of illness. CJD is a rapidly progressive, invariably fatal neurodegenerative disorder believed to be caused by an abnormal isoform of a cellular glycoprotein known as the prion protein. CJD occurs worldwide and the estimated annual incidence in many countries, including the United States, has been reported to be about one case per million population. The vast majority of CJD patients usually die within 1 year of illness onset. CJD is classified as a transmissible spongiform encephalopathy (TSE) along with other prion diseases that occur in humans and animals. In about 85% of patients, CJD occurs as a sporadic disease with no recognizable pattern of transmission. A smaller proportion of patients (5 to 15%) develop CJD because of inherited mutations of the prion protein gene. These inherited forms include Gerstmann-Straussler-Scheinker syndrome and fatal familial insomnia. No treatment is currently known for CJD.

Variant Creutzfeldt-Jakob disease (vCJD) is a prion disease that was first described in 1996 in the United Kingdom. There is now strong scientific evidence that the agent responsible for the outbreak of prion disease in cows, bovine spongiform encephalopathy (BSE or 'mad cow' disease), is the same agent responsible for the outbreak of vCJD in humans. Variant CJD (vCJD) is not the same disease as classic CJD (often simply called CJD). It has different clinical and pathologic characteristics from classic CJD. Each disease also has a particular genetic profile of the prion protein gene. Both disorders are invariably fatal brain diseases with unusually long incubation periods measured in years, and are caused by an unconventional transmissible agent called a prion. No treatment is currently known for vCJD.

BSE (bovine spongiform encephalopathy or "mad cow disease") is a progressive neurological disorder of cattle that results from infection by an unusual transmissible agent called a prion. The nature of the transmissible agent is not well understood. Currently, the most accepted theory is that the agent is a modified form of a normal protein known as prion protein. For reasons that are not yet understood, the normal prion protein changes into a pathogenic (harmful) form that then damages the central nervous system of cattle. There is increasing evidence that there are different strains of BSE: the typical or classic BSE strain responsible for the outbreak in the United Kingdom and two atypical strains (H and L strains). No treatment is currently known for BSE.

Chronic wasting disease (CWD) is a prion disease that affects deer, elk, reindeer, sika deer and moose. It has been found in some areas of North America, including Canada and the United States, Norway and South Korea. It may take over a year before an infected animal develops symptoms, which can include drastic weight loss (wasting), stumbling, listlessness and other neurologic symptoms. CWD can affect animals of all ages and some infected animals may die without ever developing the disease. CWD is fatal to animals and there are no treatments or vaccines.

The causative agents of TSEs are believed to be prions. The term "prions" refers to abnormal, pathogenic agents that are transmissible and are able to induce abnormal folding of specific normal cellular proteins called prion proteins that are found most abundantly in the brain. The functions of these normal prion proteins are still not completely understood. The abnormal folding of the prion proteins leads to brain damage and the characteristic signs and symptoms of the disease. Prion diseases are usually rapidly progressive and always fatal.

As used herein, the term "prion" shall mean an infectious particle known to cause diseases (spongiform encephalopathies) in humans and animals. The term "prion" is a contraction of the words "protein" and "infection" and the particles are comprised largely if not exclusively of $PRNP^{Sc}$ molecules encoded by a PRNP gene which expresses $PRNP^{C}$ which changes conformation to become $PRNP^{Sc}$. Prions are distinct from bacteria, viruses and viroids. Known prions include those which infect animals to cause scrapie, a transmissible, degenerative disease of the nervous system of sheep and goats as well as bovine spongiform encephalopathies (BSE) or mad cow disease and feline spongiform encephalopathies of cats. Four prion diseases, as discussed above, known to affect humans are (1) kuru, (2) Creutzfeldt-Jakob Disease (CJD), (3) Gerstmann-Strassler-Scheinker Disease (GSS), and (4) fatal familial insomnia (FFI). As used herein prion includes all forms of prions causing all or any of these diseases or others in any animals used—and in particular in humans and in domesticated farm animals.

In general, and without wishing to be bound by theory, prior diseases are caused by misfolding of prion proteins. Such diseases—often called deposition diseases—the misfolding of the prion proteins can be accounted for as follows. If A is the normally synthesized gene product that carries out an intended physiologic role in a monomeric or oligomeric state, A* is a conformationally activated form of A that is competent to undergo a dramatic conformational change, B is the conformationally altered state that prefers multimeric assemblies (i.e., the misfolded form which forms depositions) and $B_n$ is the multimeric material that is pathogenic and relatively difficult to recycle. For the prion diseases, $PRNP^{C}$ and $PRNP^{Sc}$ correspond to states A and $B_n$ where A is largely helical and monomeric and $B_n$ is β-rich and multimeric.

It is known that certain mutations in prion proteins can be associated with increased risk of prior disease. Conversely, certain mutations in prion proteins can be protective in nature. See Bagynszky et al., "Characterization of mutations in PRNP (prion) gene and their possible roles in neurodegenerative diseases," *Neuropsychiatr Dis Treat.*, 2018; 14: 2067-2085, the contents of which are incorporated herein by reference.

PRNP (NCBI RefSeq No. NP_000302.1 (SEQ ID NO: 291))—the human prion protein—is encoded by a 16 kb long gene, located on chromosome 20 (4686151-4701588). It contains two exons, and the exon 2 carries the open reading frame which encodes the 253 amino acid (AA) long PrP protein. Exon 1 is a noncoding exon, which may serve as transcriptional initiation site. The post-translational modifications result in the removal of the first 22 AA N-terminal fragment (NTF) and the last 23 AA C-terminal fragment (CTF). The NTF is cleaved after PrP transport to the endoplasmic reticulum (ER), while the CTF (glycosylphosphatidylinositol [GPI] signal peptide [GPI-SP]) is cleaved by the GPI anchor. GPI anchor could be involved in PrP protein transport. It may also play a role of attachment of prion protein into the outer surface of cell membrane. Normal PrP is composed of a long N-terminal loop (which contains the octapeptide repeat region), two short β sheets, three a helices, and a C-terminal region (which contains the GPI anchor). Cleavage of PrP results in a 208 AA long glyocoprotein, anchored in the cell membrane.

The amino acid sequence of PRNP (NP_000302.1) is as follows:

(SEQ ID NO: 291)
MANLGCWMLVLFVATWSDLGLCKKRPKPGGWNTGGSRYPGQGSPGGNRYPP

QGGGGWGQPHGGGWGQPHGGGWGQPHGGGWGQPHGGGWGQGGGTHSQWNKP

SKPKTNMKHMAGAAAAGAVVGGLGGYMLGSAMSRPIIHFGSDYEDRYYREN

MHRYPNQVYYRPMDEYSNQNNFVHDCVNITIKQHTVTTTTKGENFTETDVK

MMERVVEQMCITQYERESQAYYQRGSSMVLFSSPPVILLISFLIFLIVG.

The amino acid sequence of PRNP (NP_000302.1) is encoded by the following nucleotide sequence (NCBI Ref. Seq No. NM_000311.5, *"Homo sapiens* prion protein (PRNP), transcript variant 1, mRNA), is as follows:

(SEQ ID NO: 292)
GCGAACCTTGGCTGCTGGATGCTGGTTCTCTTTGTGGCCACATGGAGTGAC

CTGGGCCTCTGCAAGAAGCGCCCGAAGCCTGGAGGATGGAACACTGGGGGC

AGCCGATACCCGGGGCAGGGCAGCCCTGGAGGCAACCGCTACCCACCTCAG

GGCGGTGGTGGCTGGGGGCAGCCTCATGGTGGTGGCTGGGGGCAGCCTCAT

GGTGGTGGCTGGGGGCAGCCCCATGGTGGTGGCTGGGGACAGCCTCATGGT

GGTGGCTGGGGTCAAGGAGGTGGCACCCACAGTCAGTGGAACAAGCCGAGT

AAGCCAAAAACCAACATGAAGCACATGGCTGGTGCTGCAGCAGCTGGGGCA

GTGGTGGGGGGCCTTGGCGGCTACATGCTGGGAAGTGCCATGAGCAGGCCC

ATCATACATTTCGGCAGTGACTATGAGGACCGTTACTATCGTGAAAACATG

CACCGTTACCCCAACCAAGTGTACTACAGGCCCATGGATGAGTACAGCAAC

CAGAACAACTTTGTGCACGACTGCGTCAATATCACAATCAAGCAGCACACG

GTCACCACAACCACCAAGGGGGAGAACTTCACCGAGACCGACGTTAAGATG

ATGGAGCGCGTGGTTGAGCAGATGTGTATCACCCAGTACGAGAGGGAATCT

CAGGCCTATTACCAGAGAGGATCGAGCATGGTCCTCTTCTCCTCTCCACCT

GTGATCCTCCTGATCTCTTTCCTCATCTTCCTGATAGTGGGATGAGGAAGG

TCTTCCTGTTTTCACCATCTTTCTAATCTTTTTCCAGCTTGAGGGAGGCGG

TATCCACCTGCAGCCCTTTTAGTGGTGGTGTCTCACTCTTTCTTCTCTCTT

TGTCCCGGATAGGCTAATCAATACCCTTGGCACTGATGGGCACTGGAAAAC

ATAGAGTAGACCTGAGATGCTGGTCAAGCCCCCTTTGATTGAGTTCATCAT

GAGCCGTTGCTAATGCCAGGCCAGTAAAAGTATAACAGCAAATAACCATTG

GTTAATCTGGACTTATTTTTGGACTTAGTGCAACAGGTTGAGGCTAAAACA

AATCTCAGAACAGTCTGAAATACCTTTGCCTGGATACCTCTGGCTCCTTCA

GCAGCTAGAGCTCAGTATACTAATGCCCTATCTTAGTAGAGATTTCATAGC

TATTTAGAGATATTTTCCATTTTAAGAAAACCCGACAACATTTCTGCCAGG

TTTGTTAGGAGGCCACATGATACTTATTCAAAAAAATCCTAGAGATTCTTA

GCTCTTGGGATGCAGGCTCAGCCCGCTGGAGCATGAGCTCTGTGTGTACCG

AGAACTGGGGTGATGTTTTACTTTTCACAGTATGGGCTACACAGCAGCTGT

TCAACAAGAGTAAATATTGTCACAACACTGAACCTCTGGCTAGAGGACATA

TTCACAGTGAACATAACTGTAACATATATGAAAGGCTTCTGGGACTTGAAA

TCAAATGTTTGGGAATGGTGCCCTTGGAGGCAACCTCCCATTTTAGATGTT

TAAAGGACCCTATATGTGGCATTCCTTTCTTTAAACTATAGGTAATTAAGG

CAGCTGAAAAGTAAATTGCCTTCTAGACACTGAAGGCAAATCTCCTTTGTC

CATTTACCTGGAAACCAGAATGATTTTGACATACAGGAGAGCTGCAGTTGT

GAAAGCACCATCATCATAGAGGATGATGTAATTAAAAAATGGTCAGTGTGC

AAAGAAAAGAACTGCTTGCATTTCTTTATTTCTGTCTCATAATTGTCAAAA

ACCAGAATTAGGTCAAGTTCATAGTTTCTGTAATTGGCTTTTGAATCAAAG

AATAGGGAGACAATCTAAAAAATATCTTAGGTTGGAGATGACAGAAATATG

ATTGATTTGAAGTGGAAAAAGAAATTCTGTTAATGTTAATTAAAGTAAAAT

TATTCCCTGAATTGTTTGATATTGTCACCTAGCAGATATGTATTACTTTTC

TGCAATGTTATTATTGGCTTGCACTTTGTGAGTATTCTATGTAAAAATATA

TATGTATATAAAATATATATTGCATAGGACAGACTTAGGAGTTTTGTTTAG

AGCAGTTAACATCTGAAGTGTCTAATGCATTAACTTTTGTAAGGTACTGAA

TACTTAATATGTGGGAAACCCTTTTGCGTGGTCCTTAGGCTTACAATGTGC

ACTGAATCGTTTCATGTAAGAATCCAAAGTGGACACCATTAACAGGTCTTT

GAAATATGCATGTACTTTATATTTTCTATATTTGTAACTTTGCATGTTCTT

GTTTTGTTATATAAAAAAATTGTAAATGTTTAATATCTGACTGAAATTAAA

CGAGCGAAGATGAGCACCA

Mutation sites relative to PRNP (NP_000302.1) which are linked to CJD and FFI are reported are as follows. These mutations can be removed or installed using the prime editors disclosed herein.

| MUTATION | AMINO ACID SEQUENCE OF MUTANT PRNP LINKED TO CJD PRION DISEASE (SEE TABLE 1 OF BAGYNSZKY ET AL., 2018) (RELATIVE TO SEQ ID NO: 291 OF PRNP NP_000302.1) |
|---|---|
| D178N | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHNCVNITIKQHTVT TTTKGENFTETDVKMMERVVEQMCITQYERESQAYYQRGSSMVLFSSPPV ILLISFLIFLIVG (SEQ ID NO: 293) |
| T188K | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHKVT TTTKGENFTETDVKMMERVVEQMCITQYERESQAYYQRGSSMVLFSSPPV ILLISFLIFLIVG (SEQ ID NO: 294) |
| E196K | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGKNFTETDVKMMERVVEQMCITQYERESQAYYQRGSSMVLFSSPPV ILLISFLIFLIVG (SEQ ID NO: 295) |
| E196A | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGANFTETDVKMMERVVEQMCITQYERESQAYYQRGSSMVLFSSPPV (SEQ ID NO: 296) |
| E200K | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTKTDVKMMERVVEQMCITQYERESQAYYQRGSSMVLFSSPPV ILLISFLIFLIVG (SEQ ID NO: 297) |
| E200G | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTGTDVKMMERVVEQMCITQYERESQAYYQRGSSMVLFSSPPV (SEQ ID NO: 298) |
| V203I | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDIKMMERVVEQMCITQYERESQAYYQRGSSMVLFSSPPVI LLISFLIFLIVG (SEQ ID NO: 299) |
| R208H | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMEHVVEQMCITQYERESQAYYQRGSSMVLFSSPPV ILLISFLIFLIVG (SEQ ID NO: 300) |
| V210I | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHS QWNKPS KPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVIEQMCITQYERESQAYYQRGSSMVLFSSPPVI LLISFLIFLIVG (SEQ ID NO: 301) |
| E211Q | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHS QWNKPS KPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVQMCITQYERESQAYYQRGSSMVLFSSPPV ILLISFLIFLIVG (SEQ ID NO: 302) |
| M232R | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHS QWNKPS KPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSRVLFSSPPVI LLISFLIFLIVG (SEQ ID NO: 303) |

Mutation sites relative to PRNP (NP_000302.1) (SEQ ID NO: 291) which are linked to GSS are reported, as follows:

| MUTATION | AMINO ACID SEQUENCE OF MUTANT PRNP LINKED TO GSS PRION DISEASE (SEE TABLE 2 OF BAGYNSZKY ET AL., 2018) (RELATIVE TO SEQ ID NO: 291 OF PRNP NP_000302.1) |
|---|---|
| P102L | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKLSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 304) |
| P105L | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPS KLKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 305) |
| A117V | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAVAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 306) |
| G131V | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLVSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 307) |
| V176G | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFGHDCVNITIKQHTVT TTTKGENFTETDVKMMERVVEQMCITQYERESQAYYQRGSSMVLFSSPPV ILLISFLIFLIVG (SEQ ID NO: 308) |
| H187R | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHS QWNKPS KPKTNMKHMAGAAAAGAVVGGLGGYMLGSAMSRPIIHF GSDYEDRYYRENMHRYPNQVYYRPMDEYSNQNNFVHDCVNITIKQRTVT TTTKGENFTETDVKMMERVVEQMCITQYERESQAYYQRGSSMVLFSSPPV ILLISFLIFLIVG (SEQ ID NO: 309)<br><br>MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 291) |
| F198S | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENSTETDVKMMERVVEQMCITQYERESQAYYQRGSSMVLFSSPPV ILLISFLIFLIVG (SEQ ID NO: 311) |
| D202N | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETNVKMMERVVEQMCITQYERESQAYYQRGSSMVLFSSPPV ILLISFLIFLIVG (SEQ ID NO: 312) |
| Q212P | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEPMCITQYERESQAYYQRGSSMVLFSSPPV ILLISFLIFLIVG (SEQ ID NO: 313) |
| Q217R | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT |

| MUTATION | AMINO ACID SEQUENCE OF MUTANT PRNP LINKED TO GSS PRION DISEASE (SEE TABLE 2 OF BAGYNSZKY ET AL., 2018) (RELATIVE TO SEQ ID NO: 291 OF PRNP NP_000302.1) |
|---|---|
| | TTTKGENFTETDVKMMERVVEQMCITRYERESQAYYQRGSSMVLFSSPPV ILLISFLIFLIVG (SEQ ID NO: 314) |
| M232T | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSTVLFSSPPVI LLISFLIFLIVG (SEQ ID NO: 315) |

Mutation sites relative to PRNP (NP_000302.1) (SEQ ID NO: 291) which are linked to a possible protective nature against prion disease, as follows:

| MUTATION | AMINO ACID SEQUENCE OF MUTANT PRNP LINKED TO A PROTECTIVE NATURE AGAINST PRION DISEASE (SEE TABLE 4 OF BAGYNSZKY ET AL., 2018) (RELATIVE TO SEQ ID NO: 291 OF PRNP NP_000302.1) |
|---|---|
| G127S | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGSYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 316) |
| G127V | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGVYMLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 317) |
| M129V | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYVLGSAMSRPIIHF GSDYEDRYYRENMHRYPNQVYYRPMDEYSNQNNFVHDCVNITIKQHTVT TTTKGENFTETDVKMMERVVEQMCITQYERESQAYYQRGSSMVLFSSPPV ILLISFLIFLIVG (SEQ ID NO: 318) |
| D167G | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMGEYSNQNNFVHDCVNITIKQHTVT TTTKGENFTETDVKMMERVVEQMCITQYERESQAYYQRGSSMVLFSSPPV ILLISFLIFLIVG (SEQ ID NO: 319) |
| D167N | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMNEYSNQNNFVHDCVNITIKQHTVT TTTKGENFTETDVKMMERVVEQMCITQYERESQAYYQRGSSMVLFSSPPV ILLISFLIFLIVG (SEQ ID NO: 320) |
| N171S | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GS DYEDRYYRENMHRYPNQVYYRPMDEYSSQNNFVHDCVNITIKQHTVT TTTKGENFTETDVKMMERVVEQMCITQYERESQAYYQRGSSMVLFSSPPV ILLISFLIFLIVG (SEQ ID NO: 321) |
| E219K | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT TTTKGENFTETDVKMMERVVEQMCITQYKRESQAYYQRGSSMVLFSSPPV ILLISFLIFLIVG (SEQ ID NO: 322) |
| P238S | MANLGCWMLVLFVATWSDLGLCKKRPKPGGWNTGGSRYPGQGSPGGNR YPPQGGGGWGQPHGGGWGQPHGGGWGQPHGGGWGQPHGGGWGQGG GTHSQWNKPSKPKTNMKHMAGAAAAGAVVGGLGGYMLGSAMSRPIIHF GSDYEDRYYRENMHRYPNQVYYRPMDEYSNQNNFVHDCVNITIKQHTVT |

| MUTATION | AMINO ACID SEQUENCE OF MUTANT PRNP LINKED TO A PROTECTIVE NATURE AGAINST PRION DISEASE (SEE TABLE 4 OF BAGYNSZKY ET AL., 2018) (RELATIVE TO SEQ ID NO: 291 OF PRNP NP_000302.1) |
|---|---|
| | TTTKGENFTETDVKMMERVVEQMCITQYERESQAYYQRGSSMVLFSSSPV ILLISFLIFLIVG (SEQ ID NO: 323) |

Thus, in various embodiments, prime editing may be used to remove a mutation in PRNP that is linked to prion disease or install a mutation in PRNP that is considered to be protective against prion disease. For example, prime editing may be use to remove or restore a D178N, V180I, T188K, E196K, E196A, E200K, E200G, V203I, R208H, V210I, E211Q, I215V, or M232R mutation in the PRNP protein (relative to PRNP of NP_000302.1) (SEQ ID NO: 291). In other embodiments, prime editing may be use to remove or restore a P102L, P105L, A117V, G131V, V176G, H187R, F198S, D202N, Q212P, Q217R, or M232T mutation in the PRNP protein (relative to PRNP of NP_000302.1) (SEQ ID NO: 291). By removing or correcting for the presence of such mutations in PRNP using prime editing, the risk of prion disease may be reduced or eliminated.

In other embodiments, prime editing may be used to install a protective mutation in PRNP that is linked to a protective effect against one or more prion diseases. For example, prime editing may be used to install a G127S, G127V, M129V, D167G, D167N, N171S, E219K, or P238S protective mutation in PRNP (relative to PRNP of NP_000302.1) (SEQ ID NO: 291). In still other embodiments, the protective mutation may be any alternate amino acid installed at G127, G127, M129, D167, D167, N171, E219, or P238 in PRNP (relative to PRNP of NP_000302.1) (SEQ ID NO: 291).

In particular embodiments, prime editing may be used to install a G127V protective mutation in PRNP, as illustrated in FIG. 27 and discussed in Example 5.

In another embodiment, prime editing may be used to install an E219K protective mutation in PRNP.

The PRNP protein and the protective mutation site are conserved in mammals, so in addition to treating human disease it could also be used to generate cows and sheep that are immune to prion disease, or even help cure wild populations of animals that are suffering from prion disease. Prime editing has already been used to achieve ~25% installation of a naturally occurring protective allele in human cells, and previous mouse experiments indicate that this level of installation is sufficient to cause immunity from most prion diseases. This method is the first and potentially only current way to install this allele with such high efficiency in most cell types. Another possible strategy for treatment is to use prime editing to reduce or eliminate the expression of PRNP by installing an early stop codon in the gene.

Using the principles described herein for PEgRNA design, appropriate PEgRNAs may be designed for installing desired protective mutations, or for removing prion disease-associated mutations from PRNP. For example, the below list of PEgRNAs can be used to install the G127V protective allele and the E219K protective allele in human PRNP, as well as the G127V protective allele in PRNP of various animals.

| | |
|---|---|
| HUMAN PEGRNA FOR INSTALLATION OF G127V IN HUMAN PRNP: | GCAGTGGTGGGGGCCTTGGGTTTTAGAGCTAGAA ATAGCAAGTTAAAATAAGGCTAGTCCGTTATCAACTTG AAAAAGTGGCACCGAGTCGGTGC<u>ATGTAGACGCCAA GGCCCCCCAC</u> (SEQ ID NO: 324) |
| HUMAN PEGRNA FOR INSTALLATION OF E219K IN HUMAN PRNP | TGTGTATCACCCAGTACGAGGTTTTAGAGCTAGAAA TAGCAAGTTAAAATAAGGCTAGTCCGTTATCAACTTGA AAAAGTGGCACCGAGTCGGTGC <u>AGATTCTCTCTT GTACTGGGTGA</u> (SEQ ID NO: 325) |
| COW (BOS TAURUS) PEGRNA FOR INSTALLATION OF G127V IN COW PRNP | GCAGTGGTAGGGGCCTTGGGTTTTAGAGCTAGAA ATAGCAAGTTAAAATAAGGCTAGTCCGTTATCAACTTG AAAAAGTGGCACCGAGTCGGTGC<u>ATGTAGACACCAA GGCCCCCTAC</u> (SEQ ID NO: 326) |
| HAMSTER (MESOCRICETUS AURATUS) PEGRNA FOR INSTALLATION OF G127V IN HAMSTER PRNP | GCCGTGGTGGGGGCCTTGGGTTTTAGAGCTAGAA ATAGCAAGTTAAAATAAGGCTAGTCCGTTATCAACTTG AAAAAGTGGCACCGAGTCGGTGC<u>ATGTAGACACCAA GGCCCCCAC</u> (SEQ ID NO: 327) |
| MOUSE (MUS MUSCULUS) PEGRNA FOR INSTALLATION OF G127V IN MOUST PRNP | GCAGTAGTGGGGGCCTTGGGTTTTAGAGCTAGAA ATAGCAAGTTAAAATAAGGCTAGTCCGTTATCAACTTG AAAAAGTGGCACCGAGTCGGTGC<u>ATGTAGACACCAA GGCCCCCAC</u> (SEQ ID NO: 328) |
| DEER (ODOCOILEUS VIRGINIANUS) PEGRNA FOR INSTALLATION OF G127V IN DEER PNRP | GCAGTGGTAGGGGCCTTGGGTTTTAGAGCTAGAA ATAGCAAGTTAAAATAAGGCTAGTCCGTTATCAACTTG AAAAAGTGGCACCGAGTCGGTGC<u>ATGTAGACACCAA GGCCCCCTAC</u> (SEQ ID NO: 329) |

| | |
|---|---|
| FERRET (MUSTELA PUTORIUS FURO) PEGRNA FOR INSTALLATION OF G127V IN FERRET PRNP | GCGGTTGTGGGGGCCTGGGGTTTTAGAGCTAGAA ATA

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | AAGTTGGGCCATG<br>GTATG*GCCCTGAC*<br>*TGGAA*<br>(SEQ ID NO: 334) |
| POLYOMAVIRUS SIMIAN VIRUS 40 (SV40) TYPE3 | TGATCATAATCAAGCCATA TCACATCTGTAGAGGTTTA CTTGCTTTAAAAAACCTC CACACCTCCCCCTGAACC TGAAACATAAAATGAATG CAATTGTTGTTGTTAACTT GTTTATTGCAGCTTATAAT GGTTACAAATAAAGCAAT AGCATCACAAATTTCACA AATAAAGCATTTTTTTCAC TGCATTCTAGTTGTGGTTT GTCCAAACTCATCAATGTA TCTTATCATGTCTGGATCT GC (SEQ ID NO: 335) | TERMINATION OF TRANSCRIPTION OF THE TAGGED GENE; TRANSPORT OF MRNA INTO CYTOSOL; INCREASED RNA STABILITY AND EXPRESSION OF ENCODED PROTEIN | ATCCTTCCAGTCAG<br>GGCCAT<u>GTTTGAGA</u><br><u>GCTAGAAATAGCAA</u><br><u>GTTTAAATAAGGCT</u><br><u>AGTCCGTTATCAAC</u><br><u>TTGAAAAAGTGGG</u><br><u>ACCGAGTCGGTCCA</u><br>*CCTGAACCGTATATC*<br>GCAGATCCAGACA<br>TGATAAGATACATT<br>GATGAGTTTGGAC<br>AAACCACAACTAG<br>AATGCAGTGAAAA<br>AAATGCTTTATTT<br>GTGAAATTTGTGA<br>TGCTATTGCTTTAT<br>TTGTAACCATTATA<br>AGCTGCAATAAAC<br>AAGTTAACAACAA<br>CAATTGCATTCAT<br>TTTATGTTTCAGG<br>TTCAGGGGGAGG<br>TGTGGAGGTTTTT<br>TAAAGCAAGTAAA<br>CCTCTACAGATGT<br>GATATGGCTTGAT<br>TATGATCACTATGG<br>*CCCTGACTGGAA*<br>(SEQ ID NO: 336) |
| HUMAN GROWTH HORMONE (HGH) | ACGGGTGGCATCCCTGTG ACCCCTCCCCAGTGCCTC TCCTGGCCCTGGAAGTTG CCACTCCAGTGCCCACCA GCCTTGTCCTAATAAAATT AAGTTGCATCATTTTGTCT GACTAGGTGTCCTTCTATA ATATTATGGGGTGGAGGG GGGTGGTATGGAGCAAGG GGCAAGTTGGGAAGACA ACCTGTAGGGCCTGCGGG GTCTATTGGGAACCAAGC TGGAGTGCAGTGGCACAA TCTTGGCTCACTGCAATCT CCGCCTCCTGGGTTCAAG CGATTCTCCTGCCTCAGCC TCCCGAGTTGTTGGGATT CCAGGCATGCATGACCAG GCTCAGCTAATTTTTGTTT TTTTGGTAGAGACGGGGT TTCACCATATTGGCCAGGC TGGTCTCCAACTCCTAATC TCAGGTGATCTACCCACCT TGGCCTCCCAAATTGCTG GGATTACAGGCGTGAACC ACTGCTCCCTTCCCTGTCC TT (SEQ ID NO: 337) | TRANSPORT OF RNA INTO CYTOPLASM; ENHANCED RNA STABILITY AND EXPRESSION OF ENCODED PROTEIN | ATCCTTCCAGTCAG<br>GGCCAT<u>GTTTGAGA</u><br><u>GCTAGAAATAGCAA</u><br><u>GTTTAAATAAGGCT</u><br><u>AGTCCGTTATCAAC</u><br><u>TTGAAAAAGTGGG</u><br><u>ACCGAGTCGGTCCA</u><br>*CCTGAACCGTATATC*<br>AAGGACAGGGAA<br>GGGAGCAGTGGT<br>TCACGCCTGTAAT<br>CCCAGCAATTTGG<br>GAGGCCAAGGTG<br>GGTAGATCACCTG<br>AGATTAGGAGTTG<br>GAGACCAGCCTG<br>GCCAATATGGTGA<br>AACCCCGTCTCTA<br>CCAAAAAAACAAA<br>AATTAGCTGAGCC<br>TGGTCATGCATGC<br>CTGGAATCCCAAC<br>AACTCGGGAGGCT<br>GAGGCAGGAGAAT<br>CGCTTGAACCCAG<br>GAGGCGGAGATTG<br>CAGTGAGCCAAGA<br>TTGTGCCACTGCA<br>CTCCAGCTTGGTT<br>CCCAATAGACCCC<br>GCAGGCCCTACAG<br>GTTGTCTTCCCAA<br>CTTGCCCCTTGCT<br>CCATACCACCCCC<br>CTCCACCCCATAA<br>TATTATAGAAGGA<br>CACCTAGTCAGAC |

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | AAAATGATGCAAC TTAATTTTATTAGG ACAAGGCTGGTG GGCACTGGAGTG GCAACTTCCAGGG CCAGGAGAGGCA CTGGGGAGGGGT CACAGGGATGCCA CCCGTCTATGGCCC TGACTGGAA (SEQ ID NO: 338) |
| BOVINE GROWTH HORMONE (BGH) | CGACTGTGCCTTCTAGTTG CCAGCCATCTGTTGTTTGC CCCTCCCCCGTGCCTTCCT TGACCCTGGAAGGTGCCA CTCCCACTGTCCTTTCCTA ATAAAATGAGGAAATTGC ATCGCATTGTCTGAGTAGG TGTCATTCTATTCTGGGGG GTGGGGTGGGGCAGGAC AGCAAGGGGGAGGATTG GGAAGACAATAGCAGGCA TGCTGGGGATGCGGTGGG CTCTATGG (SEQ ID NO: 339) | TRANSPORT OF RNA INTO CYTOPLASM; ENHANCED RNA STABILITY AND EXPRESSION OF ENCODED PROTEIN | ATCCTTCCAGTCAG GGCCAT<u>GTTTGAGA GCTAGAAATAGCAA GTTTAAATAAGGCT AGTCCGTTATCAAC TTGAAAAAGTGGG ACCGAGTCGGTCCA</u> CCTGAACCGTATATC CCATAGAGCCCAC CGCATCCCCAGCA TGCCTGCTATTGT CTTCCCAATCCTC CCCCTTGCTGTCC TGCCCCACCCCAC CCCCCAGAATAGA ATGACACCTACTC AGACAATGCGATG CAATTTCCTCATTT TATTAGGAAAGGA CAGTGGGAGTGG CACCTTCCAGGGT CAAGGAAGGCAC GGGGGAGGGGCA AACAACAGATGGC TGGCAACTAGAAG GCACAGTCGCTAT GGCCCTGACTGGAA (SEQ ID NO: 340) |
| RABBIT BETA- GLOBIN (RBGLOB) | TTCACTCCTCAGGTGCAG GCTGCCTATCAGAAGGTG GTGGCTGGTGTGGCCAAT GCCCTGGCTCACAAATAC CACTGAGATCTTTTTCCCT CTGCCAAAAATTATGGGG ACATCATGAAGCCCCTTG AGCATCTGACTTCTGGCTA ATAAAGGAAATTTATTTTC ATTGCAATAGTGTGTTGGA ATTTTTTGTGTCTCTCACT CGGAAGGACATATGGGAG GGCAAATCATTTAAAACAT CAGAATGAGTATTTGGTTT AGAGTTTGGCAACATATG CCCATATGCTGGCTGCCAT GAACAAAGGTTGGCTATA AAGAGGTCATCAGTATATG AAACAGCCCCCTGCTGTC CATTCCTTATTCCATAGAA AAGCCTTGACTTGAGGTT AGATTTTTTTTATATTTTGT TTTGTGTTATTTTTTTCTTT AACATCCCTAAAATTTTCC TTACATGTTTTACTAGCCA GATTTTTCCTCCTCTCCTG ACTACTCCCAGTCATAGCT GTCCCTCTTCTCTTATGGA GATC (SEQ ID NO: 341) | TRANSPORT OF RNA INTO CYTOPLASM; ENHANCED RNA STABILITY AND EXPRESSION OF ENCODED PROTEIN | ATCCTTCCAGTCAG GGCCAT<u>GTTTGAGA GCTAGAAATAGCAA GTTTAAATAAGGCT AGTCCGTTATCAAC TTGAAAAAGTGGG ACCGAGTCGGTCCA</u> CCTGAACCGTATATC GATCTCCATAAGA GAAGAGGGACAG CTATGACTGGGAG TAGTCAGGAGAGG AGGAAAAATCTGG CTAGTAAAACATG TAAGGAAAATTTT AGGGATGTTAAAG AAAAAAATAACAC AAAACAAAATATA AAAAAAATCTAAC CTCAAGTCAAGGC TTTTCTATGGAATA AGGAATGGACAGC AGGGGGCTGTTTC ATATACTGATGAC CTCTTTATAGCCA ACCTTTGTTCATG GCAGCCAGCATAT GGGCATATGTTGC CAAACTCTAAACC AAATACTCATTCT GATGTTTTAAATG |

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | ATTTGCCCTCCCA TATGTCCTTCCGA GTGAGAGACACAA AAAATTCCAACAC ACTATTGCAATGA AAATAAATTTCCTT TATTAGCCAGAAG TCAGATGCTCAAG GGGCTTCATGATG TCCCCATAATTTTT GGCAGAGGGAAA AAGATCTCAGTGG TATTTGTGAGCCA GGGCATTGGCCAC ACCAGCCACCACC TTCTGATAGGCAG CCTGCACCTGAGG AGTGAACTATGGCC CTGACTGGAA (SEQ ID NO: 342) |
| THYMIDINE KINASE (TK) | GGGGGAGGCTAACTGAAA CACGGAAGGAGACAATAC CGGAAGGAACCCGCGCTA TGACGGCAATAAAAAGAC AGAATAAAACGCACGGGT GTTGGGTCGTTTGTTCATA AACGCGGGGTTCGGTCCC AGGGCTGGCACTCTGTCG ATACCCCACCGAGACCCC ATTGGGGCCAATACGCCC GCGTTTCTTCCTTTTCCCC ACCCCACCCCCAAGTTC GGGTGAAGGCCCAGGGCT CGCAGCCAACGTCGGGGC GGCAGGCCCTGCCATAG (SEQ ID NO: 343) | TRANSPORT OF RNA INTO CYTOPLASM; ENHANCED RNA STABILITY AND EXPRESSION OF ENCODED PROTEIN | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA CCTGAACCGTATATC CTATGGCAGGGCC TGCCGCCCCGACG TTGGCTGCGAGCC CTGGGCCTTCACC CGAACTTGGGGG GTGGGGTGGGGA AAAGGAAGAAAC GCGGGCGTATTGG CCCCAATGGGGTC TCGGTGGGGTATC GACAGAGTGCCA GCCCTGGGACCG AACCCCGCGTTTA TGAACAAACGACC CAACACCCGTGCG TTTTATTCTGTCTT TTTATTGCCGTCA TAGCGCGGGTTCC TTCCGGTATTGTC TCCTTCCGTGTTT CAGTTAGCCTCCC CCCTATGGCCCTGA CTGGAA (SEQ ID NO: 344) |
| MALAT1 ENE- MASCRNA | TAGGGTCATGAAGGTTTTT CTTTTCCTGAGAAAACAA CACGTATTGTTTCTCAGG TTTTGCTTTTTGGCCTTTT TCTAGCTTAAAAAAAAAA AAAGCAAAAGATGCTGGT GGTTGGCACTCCTGGTTT CCAGGACGGGGTTCAAAT CCCTGCGGCGTCTTTGCTT TGACT (SEQ ID NO: 345) | RESULTS IN RETENTION OF RNA IN NUCLEUS, TRANSCRIPT TERMINATION AND STABILIZATION | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA CCTGAACCGTATATC AGTCAAAGCAAAG ACGCCGCAGGGAT TTGAACCCCGTCC TGGAAACCAGGA GTGCCAACCACCA GCATCTTTTGCTT TTTTTTTTTTAAG CTAGAAAAAGGCC AAAAAGCAAAACC TGAGAAAACAATA |

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | CGTGTTGTTTTCT CAGGAAAAGAAAA ACCTTCATGACCC TACTATGGCCCTGA CTGGAA (SEQ ID NO: 346) |
| KSHV PANENE | TGTTTTGGCTGGGTTTTC CTTGTTCGCACCGGACAC CTCCAGTGACCAGACGGC AAGGTTTTTATCCCAGTGT ATATTGGAAAAACATGTTA TACTTTTGACAATTTAACG TGCCTAGAGCTCAAATTA AACTAATACCATAACGTAA TGCAACTTACAACATAAAT AAAGGTCAATGTTTAATCC ATAAAAAAAAAAAAAA AAAA (SEQ ID NO: 347) | RESULTS IN RETENTION OF RNA IN NUCLEUS, TRANSCRIPT TERMINATION AND STABILIZATION | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA CCTGAACCGTATATC TTTTTTTTTTTTT TTTTTATGGATTAA ACATTGACCTTTA TTTATGTTGTAAG TTGCATTACGTTAT GGTATTAGTTTAAT TTGAGCTCTAGGC ACGTTAAATTGTC AAAAGTATAACAT GTTTTTCCAATATA CACTGGGATAAAA ACCTTGCCGTCTG GTCACTGGAGGTG TCCGGTGCGAACA AGGAAAAACCCAG CCAAAACACTATG GCCCTGACTGGAA (SEQ ID NO: 348) |
| THREE, SEQUENTIAL KSHV PANENES WITH SHORT, UNCONSERVED RNA LINKERS | TGTTTTGGCTGGGTTTTC CTTGTTCGCACCGGACAC CTCCAGTGACCAGACGGC AAGGTTTTTATCCCAGTGT ATATTGGAAAAACATGTTA TACTTTTGACAATTTAACG TGCCTAGAGCTCAAATTA AACTAATACCATAACGTAA TGCAACTTACAACATAAAT AAAGGTCAATGTTTAATCC ATAAAAAAAAAAAAAA AAAAACACACTGTTTTGG CTGGGTTTTCCTTGTTCG CACCGGACACCTCCAGTG ACCAGACGGCAAGGTTTT TATCCCAGTGTATATTGGA AAAACATGTTATACTTTTG ACAATTTAACGTGCCTAG AGCTCAAATTAAACTAATA CCATAACGTAATGCAACTT ACAACATAAATAAAGGTC AATGTTTAATCCATAAAAA AAAAAAAAAAATCTC TCTGTTTTGGCTGGGTTTT CCTTGTTCGCACCGGAC ACCTCCAGTGACCAGACG GCAAGGTTTTTATCCCAGT GTATATTGGAAAAACATGT TATACTTTTGACAATTTAA CGTGCCTAGAGCTCAAAT TAAACTAATACCATAACGT AATGCAACTTACAACATA AATAAGGTCAATGTTTA ATCCATAAAAAAAAAAAA AAAAAA (SEQ ID NO: 349) | RESULTS IN RETENTION OF RNA IN NUCLEUS, TRANSCRIPT TERMINATION AND STABILIZATION, PREDICTED TO BE GREATER THAN A SINGLE PANENE | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA CCTGAACCGTATATC TTTTTTTTTTTTT TTTTTATGGATTAA ACATTGACCTTTA TTTATGTTGTAAG TTGCATTACGTTAT GGTATTAGTTTAAT TTGAGCTCTAGGC ACGTTAAATTGTC AAAAGTATAACAT GTTTTTCCAATATA CACTGGGATAAAA ACCTTGCCGTCTG GTCACTGGAGGTG TCCGGTGCGAACA AGGAAAAACCCAG CCAAAACAGAGAG ATTTTTTTTTTTT TTTTTTATGGATTA AACATTGACCTTT ATTTATGTTGTAAG TTGCATTACGTTAT GGTATTAGTTTAAT TTGAGCTCTAGGC ACGTTAAATTGTC AAAAGTATAACAT GTTTTTCCAATATA CACTGGGATAAAA ACCTTGCCGTCTG GTCACTGGAGGTG TCCGGTGCGAACA |

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | AGGAAAAACCCAG CCAAAACAGTGTG TTTTTTTTTTTTT TTTTTTATGGATTA AACATTGACCTTT ATTTATGTTGTAAG TTGCATTACGTTAT GGTATTAGTTTAAT TTGAGCTCTAGGC ACGTTAAATTGTC AAAAGTATAACAT GTTTTTCCAATATA CACTGGGATAAAA ACCTTGCCGTCTG GTCACTGGAGGTG TCCGGTGCGAACA AGGAAAAACCCAG CCAAAACACTATG *GCCCTGACTGGAA* (SEQ ID NO: 350) |
| SMBOX/U1 SNRNA BOX | CAGCAAGTTCAGAGAAAT CTGAACTTGCTGGATTTTT GGAGCAGGGAGATGGAAT AGGAGCTTGCTCCGTCCA CTCCACGCATCGACCTGG TATTGCAGTACCTCCAGG AACGGTGCACCCACTTTC TGGAGTTTCAAAAGTAGA CTGTACGCTAAGGGTCATA TCTTTTTTTGTTTGGTTTG TGTCTTGGTTGGCGTCTTA AA (SEQ ID NO: 351) | RESULTS IN RETENTION OF RNA IN NUCLEUS AND TRANSCRIPT TERMINATION | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA *CCTGAACCGTATATC* TTTAAGACGCCAA CCAAGACACAAAC CAAACAAAAAAAG ATATGACCCTTAG CGTACAGTCTACT TTTGAAACTCCAG AAAGTGGGTGCAC CGTTCCTGGAGGT ACTGCAATACCAG GTCGATGCGTGGA GTGGACGGAGCA AGCTCCTATTCCA TCTCCCTGCTCCA AAAATCCAGCAAG TTCAGATTTCTCT GAACTTGCTGCTA T*GGCCCTGACTGGAA* (SEQ ID NO: 352) |
| U1 SNRNA 3' BOX | GTTTCAAAAGTAGACTGT ACGCTAAGGGTCATATCTT TTTTGTTTGGTTTGTGTC TTGGTTGGCGTCTTAAA (SEQ ID NO: 353) | RESULTS IN RETENTION OF RNA IN NUCLEUS AND TRANSCRIPT TERMINATION | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA *CCTGAACCGTATATC* TTTAAGACGCCAA CCAAGACACAAAC CAAACAAAAAAAG ATATGACCCTTAG CGTACAGTCTACT TTTGAAACCTATGG *CCCTGACTGGAA* (SEQ ID NO: 354) |
| TRNA-LYSINE | GCCCGGCTAGCTCAGTCG GTAGAGCATGAGACTCTT AATCTCAGGGTCGTGGGT TCGAGCCCCACGTIGGGC G (SEQ ID NO: 355) | REPORTED TO ENABLE TRANSPORT OF RNA TO MITOCHONDRIA | ATCCTTCCAGTCAG GGCCATGTTTGAGA GCTAGAAATAGCAA GTTTAAATAAGGCT AGTCCGTTATCAAC TTGAAAAAGTGGG |

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | ACCGAGTCGGTCCA<br>*CCTGAACCGTATATC*<br>CGCCCAACGTGG<br>GGCTCGAACCCAC<br>GACCCTGAGATTA<br>AGAGTCTCATGCT<br>CTACCGACTGAGC<br>TAGCCGGGCCTAT<br>*GGCCCTGACTGGAA*<br>(SEQ ID NO: 356) |
| BROCCOLI APTAMER | GAGACGGTCGGGTCCAGA TATTCGTATCTGTCGAGTA GAGTGTGGGCTC (SEQ ID NO: 357) | VISUALIZATION (FLUORESCENCE) | ATCCTTCCAGTCAG<br>GGCCATGTTTGAGA<br>GCTAGAAATAGCAA<br>GTTTAAATAAGGCT<br>AGTCCGTTATCAAC<br>TTGAAAAAGTGGG<br>ACCGAGTCGGTCCA<br>*CCTGAACCGTATATC*<br>GAGCCCACACTCT<br>ACTCGACAGATAC<br>GAATATCTGGACC<br>CGACCGTCTCCTA<br>T*GGCCCTGACTGGA*<br>*A*<br>(SEQ ID NO: 358) |
| SPINACH APTAMER | GACGCAACTGAATGAAAT GGTGAAGGACGGGTCCA GGTGTGGCTGCTTCGGCA GTGCAGCTTGTTGAGTAG AGTGTGAGCTCCGTAACT AGTCGCGTC (SEQ ID NO: 359) | VISUALIZATION (FLUORESCENCE) | ATCCTTCCAGTCAG<br>GGCCATGTTTGAGA<br>GCTAGAAATAGCAA<br>GTTTAAATAAGGCT<br>AGTCCGTTATCAAC<br>TTGAAAAAGTGGG<br>ACCGAGTCGGTCCA<br>*CCTGAACCGTATATC*<br>GACGCGACTAGTT<br>ACGGAGCTCACAC<br>TCTACTCAACAAG<br>CTGCACTGCCGAA<br>GCAGCCACACCTG<br>GACCCGTCCTTCA<br>CCATTTCATTCAG<br>TTGCGTCCTATGGC<br>*CCTGACTGGAA*<br>(SEQ ID NO: 360) |
| SPINTACH2 APTAMER | GATGTAACTGAATGAAAT GGTGAAGGACGGGTCCA GTAGGCTGCTTCGGCAGC CTACTTGTTGAGTAGAGT GTGAGCTCCGTAACTAGT TACATC (SEQ ID NO: 361) | VISUALIZATION (FLUORESCENCE) | ATCCTTCCAGTCAG<br>GGCCATGTTTGAGA<br>GCTAGAAATAGCAA<br>GTTTAAATAAGGCT<br>AGTCCGTTATCAAC<br>TTGAAAAAGTGGG<br>ACCGAGTCGGTCCA<br>*CCTGAACCGTATATC*<br>GATGTAACTAGTT<br>ACGGAGCTCACAC<br>TCTACTCAACAAG<br>TAGGCTGCCGAAG<br>CAGCCTACTGGAC<br>CCGTCCTTCACCA<br>TTTCATTCAGTTA<br>CATCCTATG*GCCCT*<br>*GACTGGAA*<br>(SEQ ID NO: 362) |
| MANGO APTAMER | GGCACGTACGAAGGGACG GTGCGGAGAGGAGAGTAC GTGC (SEQ ID NO: 363) | VISUALIZATION (FLUORESCENCE) | ATCCTTCCAGTCAG<br>GGCCATGTTTGAGA<br>GCTAGAAATAGCAA<br>GTTTAAATAAGGCT<br>AGTCCGTTATCAAC<br>TTGAAAAAGTGGG<br>ACCGAGTCGGTCCA |

-continued

| RNA MOTIF | SEQUENCE OF RNA MOTIF | FUNCTION/ EFFECT | EXEMPLARY PEGRNA FOR PRIME EDITING INSERTION OF RNA MOTIF INTO THE EXEMPLARY HEXA GENE* |
|---|---|---|---|
| | | | *CCTGAACCGTATATC* GCACGTACTCTCC TCTCCGCACCGTC CCTTCGTACGTGC CCTATGGCCCTGAC TGGAA (SEQ ID NO: 364) |
| HDV RIBOZYME | GGCCGGCATGGTCCCAGC CTCCTCGCTGGCGCCGGC TGGGCAACATGCTTCGGC ATGGCGAATGGGAC (SEQ ID NO: 365) | 3' END RNA PROCESSING | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA *CCTGAACCGTATATC* GTCCCATTCGCCA TGCCGAAGCATGT TGCCCAGCCGGC GCCAGCGAGGAG GCTGGGACCATGC CGGCCCTATGGCCC TGACTGGAA (SEQ ID NO: 366) |
| N⁶-METHYL-ADENOSINE MARKER (M⁶A) | GG<u>A</u>CTCTAGG<u>A</u>CTGG<u>A</u>CT TTGG<u>A</u>CT (SEQ ID NO: 367) | TARGET FOR METHYLATION (UNDERLINED A'S ARE METHYLATED). M6A METHYLATION CAN RESULT IN ENHANCED RNA STABILITY AND EXPRESSION, BUT IS NOT YET FULLY UNDERSTOOD | ATCCTTCCAGTCAG GGCCATGTTTGAGA GCTAGAAATAGCAA GTTTAAATAAGGCT AGTCCGTTATCAAC TTGAAAAAGTGGG ACCGAGTCGGTCCA *CCTGAACCGTATATC* AGTCCAAAGTCCA GTCCTAGAGTCCC TATGGCCCTGACTG GAA (SEQ ID NO: 368) |

*each PEgRNA is shown in the 5' to 3' direction and has the following structural elements of FIG. 3F as designated by font type, as follows: 5' - spacer sequence (normal font) - gRNA core (underlined sequence) - homology arm (italicized) - RT template (bolded font) - primer binding site (italicized) - 3'.

The PEgRNAs of the above table are designed to site-specifically insert examples of the above motifs into the HEXA gene (defective in Tay-Sachs disease) (e.g., GenBank No. KR710351.1 (SEQ ID NO: 369), however, this is only for purposes of illustration. The use of prime editing in RNA tagging is not limited to the HEXA gene and indeed may be any any. The HEXA mRNA has the following nucleotide sequence:

(SEQ ID NO: 369)
GTTCGTTGCAACAAATTGATGAGCAATGCTTTTTTATAATGCCAACTTTGT

ACAAAAAAGTTGGCATGACAAGTTCCAGGCTTTGGTTTTCGCTGCTGCTGG

CGGCAGCGTTCGCAGGACGGGCGACGGCCCTCTGGCCCTGGCCTCAGAACT

TCCAAACCTCCGACCAGCGCTACGTCCTTTACCCGAACAACTTTCAATTCC

AGTACGATGTCAGCTCGGCCGCGCAGCCCGGCTGCTCAGTCCTCGACGAGG

CCTTCCAGCGCTATCGTGACCTGCTTTTCGGTTCCGGGTCTTGGCCCCGTC

CTTACCTCACAGGGAAACGGCATACACTGGAGAAGAATGTGTTGGTTGTCT

CTGTAGTCACACCTGGATGTAACCAGCTTCCTACTTTGGAGTCAGTGGAGA

ATTATACCCTGACCATAAATGATGACCAGTGTTTACTCCTCTCTGAGACTG

TCTGGGGAGCTCTCCGAGGTCTGGAGACTTTTAGCCAGCTTGTTTGGAAAT

CTGCTGAGGGCACATTCTTTATCAACAAGACTGAGATTGAGGACTTTCCCC

GCTTTCCTCACCGGGGCTTGCTGTTGGATACATCTCGCCATTACCTGCCAC

TCTCTAGCATCCTGGACACTCTGGATGTCATGGCGTACAATAAATTGAACG

TGTTCCACTGGCATCTGGTAGATGATCCTTCCTTCCCATATGAGAGCTTCA

CTTTTCCAGAGCTCATGAGAAAGGGGTCCTACAACCCTGTCACCCACATCT

ACACAGCACAGGATGTGAAGGAGGTCATTGAATACGCACGGCTCCGGGGTA

TCCGTGTGCTTGCAGAGTTTGACACTCCTGGCCACACTTTGTCCTGGGGAC

-continued
CAGGTATCCCTGGATTACTGACTCCTTGCTACCCTGGGTCTGAGCCCTCTG

GCACCTTTGGACCAGTGAATCCCAGTCTCAATAATACCTATGAGTTCATGA

GCACATTCTTCTTAGAAGTCAGCTCTGTCTTCCCAGATTTTTATCTTCATC

TTGGAGGAGATGAGGTTGATTTCACCTGCTGGAAGTCCAACCCAGAGATCC

AGGACTTTATGAGGAAGAAAGGCTTCGGTGAGGACTTCAAGCAGCTGGAGT

CCTTCTACATCCAGACGCTGCTGGACATCGTCTCTTCTTATGGCAAGGGCT

ATGTGGTGTGGCAGGAGGTGTTTGATAATAAAGTAAAGATTCAGCCAGACA

CAATCATACAGGTGTGGCGAGAGGATATTCCAGTGAACTATATGAAGGAGC

TGGAACTGGTCACCAAGGCCGGCTTCCGGGCCCTTCTCTCTGCCCCCTGGT

ACCTGAACCGTATATCCTATGGCCCTGACTGGAAGGATTTCTACGTAGTGG

AACCCCTGGCATTTGAAGGTACCCCTGAGCAGAAGGCTCTGGTGATTGGTG

GAGAGGCTTGTATGTGGGGAGAATATGTGGACAACACAAACCTGGTCCCCA

GGCTCTGGCCCAGAGCAGGGGCTGTTGCCGAAAGGCTGTGGAGCAACAAGT

TGACATCTGACCTGACATTTGCCTATGAACGTTTGTCACACTTCCGCTGTG

AGTTGCTGAGGCGAGGTGTCCAGGCCCAACCCCTCAATGTAGGCTTCTGTG

AGCAGGAGTTTGAACAGACCTGCCCAACTTTCTTGTACAAAGTTGGCATTA

TAAGAAAGCATTGCTTATCAATTTGTTGCAACGAAC.

The corresponding HEXA protein has the following amino acid sequence:

(SEQ ID NO: 370)
MTSSRLWFSLLLAAAFAGRATALWPWPQNFQTSDQRYVLYPNNFQFQYDV

SSAAQPGCSVLDEAFQRYRDLLFGSGSWPRPYLTGKRHTLEKNVLVVSVV

TPGCNQLPTLESVENYTLTINDDQCLLLSETVWGALRGLETFSQLVWKSA

EGTFFINKTEIEDFPRFPHRGLLLDTSRHYLPLSSILDTLDVMAYNKLNV

FHWHLVDDPSFPYESFTFPELMRKGSYNPVTHIYTAQDVKEVIEYARLRG

IRVLAEFDTPGHTLSWGPGIPGLLTPCYPGSEPSGTFGPVNPSLNNTYEF

MSTFFLEVSSVFPDFYLHLGGDEVDFTCWKSNPEIQDFMRKKGFGEDFKQ

LESFYIQTLLDIVSSYGKGYVVWQEVFDNKVKIQPDTIIQVWREDIPVNY

MKELELVTKAGFRALLSAPWYLNRISYGPDWKDFYVVEPLAFEGTPEQKA

LVIGGEACMWGEYVDNTNLVPRLWPRAGAVAERLWSNKLTSDLTFAYERL

SHFRCELLRRGVQAQPLNVGFCEQEFEQT.

Notably, the resulting RNA motifs would be included within the translated region of the HEXA gene, disrupting the function of the protein coding gene. Inserted polyadenylation motifs would result in premature transcript termination. This site is merely illustrative of the potential PEgRNAs that could result in insertion of the listed RNA motifs of the above table within a genomic site that is transcribed and thus which would produce an RNA product.

PEgRNAs for use with PE for RNA tagging could be be expressed from a U6 promoter (in which case a single guanosine would be added to the 5' end of the PEgRNA for guides that include proto spacers that do not begin with a G and 6-7 thymine would be added to the 3' end) or a pol II promoter such as pCMV (in which case it might be necessary to remove the intrinsically transcribed sequence of this promoter from the 5' end of the RNA via a self-cleaving element or Csy4 motif, and a termination motif would need to be added to the 3' end of the RNA that does not result in export of the RNA from the nucleus, such as the 3' box motif listed above. Note that this motif would not be inserted into the genome as a result of PE, as it would be 3' of the annealing region). The core PEgRNA scaffold is underlined, the homology and annealing regions are italicized, and the inserted sequence is bolded. Note that the sequence inserted is the reverse complement of the above examples—as described below and therefore these PEgRNAs would need to be targeted to the coding strand.

Also, note that self-cleaving ribozymes other than HDV need in some embodiments to be tailored to the given target site; that is, while HDV cleaves the encoded transcript immediately 5' to itself, the cut sites for all other self-cleaving ribozymes are within the ribozyme itself. Therefore, the first and last roughly 5-10 nucleotides (and in some instances potentially more than 10) would actually be a part of the encoded sequence. As an example, to cleave the sequence 5'-NNNNNTCATCCTGATAAACTGCAAA-3' (SEQ ID NO: 371) after the 5 Ns, where N is any nucleotide, using a hammerhead self-cleaving ribozyme, the following sequence would be inserted, where the underlined sequences form an imperfect RNA pairing element.

(SEQ ID NO: 372)
5'NNNNN<u>CAGTTTGTACGGAT</u>GACTGATGAGTCCCAAATAGGACGAAACG

CGCTTCGGTGCGTCTCATCCTGATAAACTGCAAA-3'.

There is significant flexibility in terms of the length and nature of this pairing element, and this would be true for any of the non-HDV self-cleaving ribozymes listed in the original submission. To install a hammerhead ribozyme to cleave the hexA mRNA using a PEgRNA with the same protospacer as the above listed constructs, the following PEgRNA sequence could be used (labels same as above):

5' ACCTGAACCGTATATCGACGCACCGAAGCGCGTTTCGTCCTATTTGG

GACTCATCAGGATATACGGTTCAGGTGATATACGGTTCAGGTGACGCAC

CGAAGCGCGTTTCGTCCTATTTGGGACTCATCAGACCTGAACCGTATAT

CATCCTTCCAGTCAGGGCCAT<u>GTTTGAGAGCTAGAAATAGCAAGTTTAA</u>

<u>ATAAGGCTAGTCCGTTATCAACTTGAAAAAGTGGGACCGAGTCGGTCCA</u>

CCTGAACCGTATATCGACGCACCGAAGCGCGTTTCGTCCTATTTGGGAC

TCATCAGGATATACGGTTCAGGTCTATGCCCTGACTGGAA-3'

(wherein the core PEgRNA scaffold is underlined, the homology and annealing regions are italicized, and the inserted sequence is bolded) (SEQ ID NO: 373).

Designing other PEgRNA for insertion of RNA motifs may follow the general principle described herein. However, it is noted that many of RNA motifs are potentially highly structured, which could make it difficult for them to be reverse-transcribed and inserted into the genome. Although for some RNA sequences, such as simple hairpins, both the RNA sequence itself and its complement are structured. However, that is unlikely to be true for the sequences noted above. Therefore, when inserting these motifs, it would most likely be best for the PEgRNA to encode the reverse complement of these sequences, resulting in the insertion of the DNA sequence actually encoding the motif into the genome. Similarly, inclusion of a self-cleaving ribozyme in the PEgRNA template region would result in processing and inefficient activity, while inclusion of its reverse complement would not. Thus, these PEgRNAs will likely have to target the coding strand, whereas PEgRNAs encoding other types of insertions (such as therapeutic correction) would be able to theoretically target either strand.

Also, note that for many of the inserted motifs, the resulting PEgRNA might not be able to be transcribed from the U6 promoter, necessitating use of other promoters, such as pCMV. Similarly, longer PEgRNAs could also be less stable. Shorter motifs, such as $m^6A$ markers, would not have this challenge.

G. Use of Prime Editing for Generation of Sophisticated Gene Libraries

Prime editing may also be used to generate sophisticated libraries of protein- or RNA-coding genes with defined or variable insertions, deletions, or defined amino acid/nucleotide conversions, and their use in high-throughput screening and directed evolution is described herein. This application of prime editing can be further described in Example 7.

The generation of variable genetic libraries has most commonly been accomplished through mutagenic PCR (see Cadwell R C and Joyce G F. PCR Methods Appl. 1992). This method relies on either using reaction conditions that reduce the fidelity of DNA polymerase, or using modified DNA polymerases with higher mutation rates. As such, biases in these polymerases are reflected in the library product (e.g. a preference for transition mutations versus transversions). An inherent limitation of this approach to library construction is a relative inability to affect the size of the gene being varied. Most DNA polymerases have extremely low rates of indel mutations (insertions or deletions), and most of these will result in frameshift mutations in protein-coding regions, rendering members of the library unlikely to pass any downstream selection (See McInerney P, Adams P, and Hadi M Z. Mol Biol Int. 2014).

Additionally, biases in PCR and cloning can make it difficult to generate single libraries consisting of genes of different sizes. These limitations can severely limit the efficacy of directed evolution to enhance existing or engineer novel protein functions. In natural evolution, large changes in protein function or efficacy are typically associated with insertion and deletion mutations that are unlikely to occur during canonical library generation for mutagenesis. Furthermore, these mutations most commonly occur in regions of the protein in question that are predicted to form loops, as opposed to the hydrophobic core. Thus, most indels generated using a traditional unbiased approach are likely to either be deleterious or ineffective.

Libraries that could bias such mutations to the sites within the protein where they would be most likely to be beneficial, e.g., loop regions, would have a significant advantage over traditional libraries given that all libraries access only a fraction of the possible mutation space. Finally, although it is possible to generate genetic libraries with site-specific indel mutations through multistep PCR and clonal assembly using NNK primers or via DNA shuffling, these libraries cannot undergo additional rounds of 'indelgenesis' in continual evolution. Continuous evolution is a type of directed evolution with minimal user intervention. One such example is PACE (see Esvelt K M, Carlson J C, and Liu D R. Nature. 2011). Because continuous evolution occurs with minimal user intervention, any increase in library diversity during the evolution must occur using the native replication machinery. As such, although libraries of genes with inserted or removed codons as specific loci can be generated and screened in PACE, additional rounds of 'indelgenesis' are not possible.

It is envisioned that the programmability of prime editing (PE) can be leveraged to generate highly sophisticated, programmed genetic libraries for use in high-throughput screening and directed evolution (see FIG. 29A). PE can insert, change or remove defined numbers of nucleotides from specified genetic loci using information encoded in a prime editing guide RNA (PEgRNA) (see FIG. 29B). This enables the generation of targeted libraries with one or more amino acids inserted or removed from the loop regions wherein mutations are most likely to give rise to changes in function, without background introduction of nonfunctional frameshift mutations (see FIG. 29C). PE can be used to install specific sets of mutations without regard for biases inherent in either DNA polymerase or the sequence being mutated.

For instance, while converting a CCC codon to a stop codon would be an unlikely occurrence via canonical library generation because it would require three consecutive mutations, including two transversions, PE could be used to convert any given, targeted codon to a TGA stop codon in one step. They could also be used to install programmed diversity at given positions, for instance by incorporating codons encoding any hydrophobic amino acid at a given site, while not encoding any others. Furthermore, because of the programmability of PE, multiple PEgRNAs could be utilized to generate multiple different edits at multiple sites simultaneously, enabling the generation of highly programmed libraries (see FIG. 29D). Additionally, it is possible to use reverse transcriptases with lower fidelity to generate regions of mutagenesis within an otherwise invariable library (such as the HIV-I reverse transcriptase or *Bordetella* phage reverse transcriptase) (see Naorem S S, Hin J, Wang S, Lee W R, Heng X, Miller J F, Guo H. Proc Natl Acad Sci 2017 and Martinez M A, Vartanian J P, Wain-Hobson S. Proc Natl Acad Sci USA 1994).

The possibility of iterative rounds of PE on the same site is also envisioned, allowing—for instance—the repeated insertion of codons at a single site, e.g., in a loop region. Also, it is envisioned that all of the above described approaches can be incorporated into continual evolution, enabling the generation of novel in situ evolving libraries (see FIG. 30). They could also be used to construct these libraries within other cell types where it would otherwise be difficult to assemble large libraries, for instance within mammalian cells. Generation of PE-encoding bacterial strains that have been optimized for directed evolution would be a useful additional tool for the identification of proteins and RNAs with improved or novel functionality. All of these uses of PE are non-obvious due to the novel nature of PEs. In conclusion, library generation via PE would be a highly useful tool in synthetic biology and directed evolution, as well as for high-throughput screening of protein and RNA combinatorial mutants.

Competing Approaches

The chief method by which diverse libraries are currently generated is by mutagenic PCR (see Cadwell RC and Joyce GF. PCR Methods Appl. 1992), described above. Insertions or deletions can be introduced via degenerated NNK primers at defined sites during PCR, although introducing such mutations at multiple sites requires multiple rounds of iterative PCR and cloning before constructing a more diverse library via mutagenic PCR, rendering the method slow. An alternative, complementary method is DNA shuffling, where fragments of a library of genes generated via DNase treatment are introduced into a PCR reaction without primers, resulting in the annealing of different fragments to each other and the rapid generation of more diverse libraries than via mutagenic PCR alone (see Meyer A J, Ellefson J W, Ellington A D. Curr Protoc Mol Biol. 2014). Although this approach can theoretically generate indel mutations, it more often results in frameshift mutations that destroy gene function. Furthermore, DNA shuffling requires a high degree of homology between gene fragments.

Both of these methods must be done in vitro, with the resulting library transformed into cells, while libraries generated by PE can be constructed in situ, enabling their use in continual evolution. While libraries can be constructed in situ through in vivo mutagenesis, these libraries rely on the host cellular machinery and exhibit biases against indels. Similarly, although traditional cloning methods can be used to generate site-specific mutational profiles, they cannot be used in situ and are generally assembled one at a time in vitro before being transformed into cells. The efficiency and broad functionality of PE in both prokaryotic and eukaryotic cell types further suggests that these libraries could be constructed directly in the cell type of interest, as opposed to being cloned into a model organism such as E. coli and then transferred into the cell or organism of interest. Another competing approach for targeted diversification is automated multiplex genome engineering, or MAGE, wherein multiple single-stranded DNA oligonucleotides can be incorporated within replication forks and result in programmable mutations[7]. However, MAGE requires significant modification of the host strain and can lead to a 100-fold increase in off-target or background mutations (see Nyerges Á et al. Proc Natl Acad Sci USA. 2016), whereas PE is more highly programmed and anticipated to result in fewer off-target effects. Additionally, MAGE has not been demonstrated in a wide variety of cell types, including mammalian cells.

By contrast, prime editing is a novel and non-obvious complementary technique for library generation.

Use of PE for Constructing Gene Libraries

PE may be used to construct gene libraries in a programmable manner.

In one example, PE can be used in a directed evolution experiment to introduce protein variants into gene libraries during a continual evolution experiment using PACE, permitting iterative accumulation of both point mutations and indels in a manner not possible via traditional approaches.

It has already been shown that PE can site-specifically and programmably insert nucleotides into a genetic sequence in E. coli. Directed evolution can be used to identify monobodies with improved binding to a specific epitope via a modified two-hybrid protein:protein binding PACE selection. Specific and highly variable loops within these monobodies contribute significantly to affinity and specificity. Improved monobody binding might be obtained rapidly in PACE by varying the length and composition of these loops in a targeted fashion. However, varying sequence length is not an established functionality of PACE. While library of varied loop sizes might be used as a starting point for PACE, no subsequent improvements to length would arise throughout the PACE selection, barring access to beneficial synergistic combinations of point mutations and indel mutations.

In various embodiments, PE can be used to improve the PACE selection by enabling the in situ generation and evolution of monobodies with varying loop lengths. To do so, the PACE E. coli strain may be introduced to an additional PE plasmid, which encodes the PE enzyme and one or more PEgRNAs. Expression of PE enzyme and PEgRNAs in the E. coli would be under the control of a small molecule delivered to the PACE lagoon at a rate selected by the experimenter.

In various embodiments, the PEgRNA components would contain a spacer directing the PE to the site of interest on the selection phage and would be designed such that a multiple of three nucleotides could be inserted at the target site such that a new PEgRNA binding site would be introduced, enabling the iterative insertion of one or more codons at the targeted site.

In parallel, another host E. coli strain might include PEgRNAs that would template the removal of one or more codons, enabling loop size to shrink during the evolution. A PACE experiment might utilize a mixture of both strains or alternate the two to permit the slow and controlled addition or removal of loop sequences.

In addition to the use of PE and PACE to create monobody libraries, this technique can also be applied to the evolution of antibodies using PE and PACE. The binding principles governing antibodies are very similar to those governing monobodies: the length of antibody complement-determining region loops is critical to their binding function. Further, longer loop lengths have been found to be critical in the development of rare antibodies with broadly protective activity against HIV-1 and other viral infections (see Mascola J R, Haynes B F. Immunol Rev. 2013). Application of PE as described above to an antibody or antibody-derived molecule would permit the generation of antibodies with diverse loop length and varied loop sequence. In combination with PACE, such an approach would permit enhanced binding through loop geometries not accessible to standard PACE, and thus permit evolution of highly functional antibodies.

As a non-limiting example, the following PEgRNAs could be used to programmably modify the genome of a bacteriophage used in a continuous evolution experiment:

| MODIFI-CATION | PEGRNA SEQUENCE |
|---|---|
| CCA INSERTION | UACACCAUCACGGUCUAUGCGUUUUAGAGCUAGAAAUAGC AAGUUAAAAUAAGGCUAGUCCGUUAUCAACUUGAAAAAGU GGCACCGAGUCGGUGCUAUCUUCGCCCCAUGCAUAGACCG UGAUGG (SEQ ID NO: 101) |
| 1 NT DELETION | CGCGUCGCGCUCGUCAGAUCGUUUUAGAGCUAGAAAUAGC AAGUUAAAAUAAGGCUAGUCCGUUAUCAACUUGAAAAAGU GGCACCGAGUCGGUGCUUUCCGCCUACCUGCAUCUGACGA GCGCGA (SEQ ID NO: 102) |
| POINT MUTATION | AUCGGAGAAUACAUGAACAUGUUUUAGAGCUAGAAAUAGC AAGUUAAAAUAAGGCUAGUCCGUUAUCAACUUGAAAAAGU GGCACCGAGUCGGUGCCGGAGAAUACAUGAACAUCGGACC CGCGCUAUCUUC (SEQ ID NO: 103) |
| NNN INSERTION (N = A/T/G/C) | UACACCAUCACGGUCUAUGCGUUUUAGAGCUAGAAAUAGC AAGUUAAAAUAAGGCUAGUCCGUUAUCAACUUGAAAAAGU GGCACCGAGUCGGUGCUAUCUUCGCCNNNUGCAUAGACCG UGAUGG (SEQ ID NO: 104) |
| ITERATIVE GGG INSERTION | UACACCAUCACGGUCUAUGCGUUUUAGAGCUAGAAAUAGC AAGUUAAAAUAAGGCUAGUCCGUUAUCAACUUGAAAAAGU GGCACCGAGUCGGUGCGGGGGGGGGGGGGUGCAUAGACCG UGAUGG (SEQ ID NO: 105) |

In various embodiments, the use of PE for constructing gene libraries may make the use of the mutagenic activity of error-prone reverse transcriptases. The use of such mutagenic reverse transcriptase may facilitate the generation of mutagenized programmable libraries due to the lower fidelity of the error-prone RTs. As used herein, the term "error-prone" reverse transcriptase refers to a reverse transcriptase enzyme that occurs naturally or which has been derived from another reverse transcriptase (e.g., a wild type M-MLV reverse transcriptase) which has an error rate that is less than the error rate of wild type M-MLV reverse transcriptase. The error rate of wild type M-MLV reverse transcriptase is reported to be in the range of one error in 15,000 to 27,000 nucleobase incorporations. See Boutabout et al. (2001) "DNA synthesis fidelity by the reverse transcriptase of the yeast retrotransposon Ty1," *Nucleic Acids Res* 29(11):2217-2222, which is incorporated herein by reference.

Thus, for purposes of this application, the term "error prone" refers to those RT that have an error rate that is greater than one error in 15,000 nucleobase incorporation ($6.7 \times 10^{-5}$ or higher), e.g., 1 error in 14,000 nucleobases ($7.14 \times 10^{-5}$ or higher), 1 error in 13,000 nucleobases or fewer ($7.7 \times 10^{-5}$ or higher), 1 error in 12,000 nucleobases or fewer ($7.7 \times 10^{-5}$ or higher), 1 error in 11,000 nucleobases or fewer ($9.1 \times 10^{-5}$ or higher), 1 error in 10,000 nucleobases or fewer ($1 \times 10^{-4}$ or 0.0001 or higher), 1 error in 9,000 nucleobases or fewer (0.00011 or higher), 1 error in 8,000 nucleobases or fewer (0.00013 or higher) 1 error in 7,000 nucleobases or fewer (0.00014 or higher), 1 error in 6,000 nucleobases or fewer (0.00016 or higher), 1 error in 5,000 nucleobases or fewer (0.0002 or higher), 1 error in 4,000 nucleobases or fewer (0.00025 or higher), 1 error in 3,000 nucleobases or fewer (0.00033 or higher), 1 error in 2,000 nucleobase or fewer (0.00050 or higher), or 1 error in 1,000 nucleobases or fewer (0.001 or higher), or 1 error in 500 nucleobases or fewer (0.002 or higher), or 1 error in 250 nucleobases or fewer (0.004 or higher).

A variety of mutagenic RTs could be envisioned for generation of highly mutagenized programmable libraries. Two such examples are the mutagenic reverse transcriptases from *Bordetella* phage (see Handa, S., et al. *Nucl Acids Res* 9711-25 (2018), which is incorporated herein by reference) and *Legionella pneumophila* (see Arambula, D., et al. *Proc Natl Acad Sci USA* 8212-7 (2013), which is incorporated by reference). In the case of the RT from *Bordetella* phage (brt), an accessory protein might need to also be added (bavd) to Cas9—or delivered in trans—as well as additional RNA sequences to the PEgRNA to improve binding of the mutagenic RT to the target site (see Handa, S., et al. *Nucl Acids Res* 9711-25 (2018)). When using mutagenic RTs, the template region of the PEgRNA might be enriched in adenosines or AAY codons to enhance diversity.

The amino acid sequence of the mutagenic RT from *Bordetella* phage is provided as follows. Like other RTs disclosed herein, the Brt protein may be fused to a napDNAbp as a fusion protein to form a functional PE.

| Name | Sequence |
|---|---|
| brt mutagenic rt | MGKRHRNLIDQITTWENLLDAYRKTSHGKRRTWGYLEFKE YDLANLLALQAELKAGNYERGPYREFLVYEPKPRLISALE FKDRLVQHALCNIVAPIFEAGLLPYTYACRPDKGTHAGVC HVQAELRRTRATHFLKSDFSKFFPSIDRAALYAMIDKKIH CAATRRLLRVVLPDEGVGIPIGSLTSQLFANVYGGAVDRL LHDELKQRHWARYMDDIVVLGDDPEELRAVFYRLRDFASE RLGLKISHWQVAPVSRGINFLGYRIWPTHKLLRKSSVKRA KRKVANFIKHGEDESLQRFLASWSGHAQWADTHNLFTWME EQYGIACH (SEQ ID NO: 129) |

In the case of Brt from Bodetella, the PE fusion may also include an additional accessory protein (Bavd). The accessory protein may be fused to the PE fusion protein or provided in trans. The amino acid sequence of Bavd accessory protein is provided as follows:

| Name | Sequence |
|---|---|
| bavd accessory protein to brt | MEPIEEATKCYDQMLIVERYERVISYLYPIAQSIPRKHGV AREMFLKCLLGQVELFIVAGKSNQVSKLYAADAGLAMLRF WLRFLAGIQKPHAMTPHQVETAQVLIAEVGRILGSWIARV NRKGQAGK (SEQ ID NO: 236) |

In the case of Brt from Bodetella, the PEgRNA may comprise an additional nucleotide sequence added a PEgRNA, e.g., to the 5' or 3' end. Exemplary sequence is as follows, which is originally from the *Bordetella* phage genome:

| NAME | SEQUENCE |
|---|---|
| PEGRNA-ADDITION 1 | ACCUUCUUGCAUGGCUCUGCCAACGCUACGGCUUGGCGGGC UGGCCUUUCCUCAAUAGGUGGUCAGCCGGUUCUGUCCUGCU UCGGCGAACACGUUACACGGUUCGGCAAAACGUCGAUUACU GAAAAUGGAAAGGCGGGGCCGACUUCAAGGGCAGGCUGGGA AAUAA (SEQ ID NO: 237) |

This PEgRNA addition sequence can be reduced in various ways to shorten the length. For example, the PEgRNA-addition 1 sequence could be reduced to the following exemplary alternative addition sequences:

| NAME | SEQUENCE |
|---|---|
| PEGRNA-ADDITION 2 | ACCUUCUUGCAUGGCUCUGCCAACGCUACGGCUUGGCGGGC UGGCCUUUCCUCAAUAGGUGGUCAGCCGGUUCUGUCCUGCU UCGGCGAACACGUUACACGGUUCGGCAAAACGUCGAUUACU GAAAAUGGAAAGGCGGGGCCGACUUC (SEQ ID NO: 238) |
| PEGRNA-ADDITION 3 | ACCUUCUUGCAUGGCUCUGCCAACGCUACGGCUUGGCGGGC UGGCCUUUCCUCAAUAGGUGGUCAAAGGGCAGGCUGGGAAA UAA (SEQ ID NO: 239) |
| PEGRNA-ADDITION 4 | ACCUUCUUGCAUGGCUCUGCCAACGCUACGGCUUGGCGGGC UGGCCUUUCCUCAAUAGGUGGUCA (SEQ ID NO: 277) |
| PEGRNA-ADDITION 5 | CAUGGCUCUGCCAACGCUACGGCUUGGCGGGCUGGCCUUUC CUCAAUAGGUGGUCAGCCGGUUCUGUCCUGCUUCGGCGAAC ACGUUACACGGUUCGGCAAAACGUCGAUUACUGAAAAUGGA AAGGCGGGGCCGACUUCAAGGGCAGGCUGGGAAAUAA (SEQ ID NO: 240) |
| PEGRNA-ADDITION 6 | CAUGGCUCUGCCAACGCUACGGCUUGGCGGGCUGGCCUUUC CUCAAUAGGUGGUCAGCCGGUUCUGUCCUGCUUCGGCGAAC ACGUUACACGGUUCGGCAAAACGUCGAUUACUGAAAAUGGA AAGGCGGGGCCGACUUC (SEQ ID NO: 241) |
| PEGRNA-ADDITION 7 | CAUGGCUCUGCCAACGCUACGGCUUGGCGGGCUGGCCUUUC CUCAAUAGGUGGUCAAAGGGCAGGCUGGGAAAUAA (SEQ ID NO: 242) |
| PEGRNA-ADDITION 8 | CAUGGCUCUGCCAACGCUACGGCUUGGCGGGCUGGCCUUUC CUCAAUAGGUGGUCA (SEQ ID NO: 243) |

In other embodiments, the PEgRNA addition sequence can be also be mutated. For example, the PEgRNA-addition 1 sequence could be mutated to the following exemplary alternative addition sequence:

| NAME | SEQUENCE |
|---|---|
| PEGRNA-ADDITION 1 MUTATED | ACCUUCUUGCAUGGCUCUGCCAACGCUACGGCUUGGCGGGC UGGCCUUUCCUCAAUAGAUGAGCCGCCGGUUCUGUCCUGCU UCGGCGAACACGUUACACGGUUCGCAAAACGUCGAUUACU GAAAAUGGAAAGGCGGGGCCGACUUCAAGGGCAGGCUGGGA AAUAA (SEQ ID NO: 244) |

In various embodiments relating to the use of PE for designing gene libraries, special PEgRNAs considerations may apply. For example, without wishing to be bound by theory, the additional PEgRNA sequences described above might be needed to enable efficient mutagenesis via mutagenic RTs. In another embodiment, iterative codon insertion using PE may required specific PEgRNA designs. For example, to insert a GGG (glycine) codon iteratively, the entire homology region of the PEgRNA might need to be composed of Gs, as shown above. This would mean that only certain sites could go iterative insertion. Additionally, the PAM sequence would not be able to be disrupted by the PE.

H. Use of Prime Editing for Insertion of Immunoepitopes

Prime editors may also be used as a means to insert known immunogenicity epitopes into endogenous or foreign genomic DNA, resulting in modification of the corresponding proteins for therapeutic or biotechnological applications (see FIGS. 31 and 32). Prior to the invention of prime editing, such insertions could be achieved only inefficiently and with high rates of indel formation from DSBs. prime editing solves the problem of high indel formation from insertion edits while generally offering higher efficiency than HDR. This lower rate of indel formation presents a major advantage of prime editing over HDR as a method for targeted DNA insertions, especially in the described application of inserting immunogenicity epitopes. The length of epitopes is in a range from few bases to hundreds of bases. Prime editor is an efficient approach to achieve such targeted insertions in mammalian cells.

The key concept of the invention is the use of prime editors to insert a nucleotide sequence containing previously described immunogenicity epitopes into endogenous or foreign genomic DNA for the downregulation and/or destruction of their protein products and/or expressing cell types. Nucleotide sequences for immunogenic epitope insertion would be targeted to genes in a manner to produce fusion proteins of the targeted gene's coded protein and the inserted immunogenic epitope's corresponding protein translation. Patient's immune systems will have been previously trained to recognize these epitopes as a result of standard prior immunization from routine vaccination against, for example, tetanus or diphtheria or measles. As a result of the immunogenic nature of the fused epitopes, patient's immune systems would be expected to recognize and disable the prime edited protein (not just the inserted epitope) and potentially the cells from which it was expressed.

Precise genome targeting technologies using the CRISPR/Cas system have recently been explored in a wide range of applications, including the insertion of engineered DNA sequences into targeted genomic loci. Previously, homology-directed repair (HDR) has been used for this application, requiring an ssDNA donor template and repair initiation by means of a double-stranded DNA break (DSB). This strategy offers the broadest range of possible changes to be made in cells and is the only method available to insert large DNA sequences into mammalian cells. However, HDR is hampered by undesired cellular side effects stemming from its initiating DSB, such as high levels of indel formation, DNA translocations, large deletions, and P53 activation. In addition to these drawbacks, HDR is limited by low efficiency in many cell types (T cells are a notable exception to this observation). Recent efforts to overcome these drawbacks include fusing human Rad51 mutants to a Cas9 D10A nickase (RDN), resulting in a DSB-free HDR system that features improved HDR product:indel ratios and lower off target editing, but is still hampered by cell-type dependencies and only modest HDR editing efficiency.

Recently developed fusions of Cas9 to reverse transcriptases ("Prime editors") coupled with PEgRNAs represent a novel genome editing technology that offers a number of advantages over existing genome editing methods, including the ability to install any single nucleotide substitution, and to insert or delete any short stretch of nucleotides (up to at least several dozen bases) in a site-specific manner. Notably, PE edits are achieved with generally low rates of unintended indels. As such, PE enables targeted insertion-based editing applications that have been previously impossible or impractical.

This particular aspect describes a method for using prime editing as a means to insert known immunogenicity epitopes into endogenous or foreign genomic DNA, resulting in modification of the corresponding proteins for therapeutic or biotechnological applications (see FIGS. 31 and 32). Prior to the invention of prime editing, such insertions could be achieved only inefficiently and with high rates of indel formation from DSBs. prime editing solves the problem of high indel formation from insertion edits while generally offering higher efficiency than HDR. This lower rate of indel formation presents a major advantage of prime editing over HDR as a method for targeted DNA insertions, especially in the described application of inserting immunogenicity epitopes. The length of epitopes is in a range from few bases to hundreds of bases. Prime editor is the most efficient and cleanest technology to achieve such targeted insertions in mammalian cells.

The key concept of this aspect is the use of prime editors to insert a nucleotide sequence containing previously described immunogenicity epitopes into endogenous or foreign genomic DNA for the downregulation and/or destruction of their protein products and/or expressing cell types. Nucleotide sequences for immunogenic epitope insertion would be targeted to genes in a manner to produce fusion proteins of the targeted gene's coded protein and the inserted immunogenic epitope's corresponding protein translation. Patient's immune systems will have been previously trained to recognize these epitopes as a result of standard prior immunization from routine vaccination against, for example, tetanus or diphtheria or measles. As a result of the immunogenic nature of the fused epitopes, patient's immune systems would be expected to recognize and disable the prime edited protein (not just the inserted epitope) and potentially the cells from which it was expressed.

Fusions to targeted genes would be engineered as needed to ensure the inserted epitope protein translation is exposed for immune system recognition. This could include targeted nucleotide insertions resulting in protein translations yielding C-terminal fusions of immunogenicity epitopes to targeted genes, N-terminal fusions of immunogenicity epitopes to targeted genes, or the insertion of nucleotides into genes so that immunogenicity epitopes are coded within surfaced-exposed regions of protein structure.

Protein linkers encoded as nucleotides inserted between the target gene sequence and the inserted immunogenicity epitope nucleotide sequence may need to be engineered as part of this invention to facilitate immune system recognition, cellular trafficking, protein function, or protein folding of the targeted gene. These inserted nucleotide-encoded protein linkers may include (but are not limited to) variable lengths and sequences of the XTEN linker or variable lengths and sequences of Glycine-Serine linkers. These engineered linkers have been previous used to successfully facilitate protein fusions. Exemplary linkers may include any of those described herein, including the amino acid sequence (GGGGS)n (SEQ ID NO: 165), (G)n (SEQ ID NO: 166), (EAAAK)n (SEQ ID NO: 167), (GGS)n (SEQ ID NO: 168), (SGGS)n (SEQ ID NO: 169), (XP)n (SEQ ID NO: 170), or any combination thereof, wherein n is independently an integer between 1 and 30, and wherein X is any amino acid. In some embodiments, the linker comprises the amino acid sequence (GGS)n (SEQ ID NO: 176), wherein n is 1, 3, or 7. In some embodiments, the linker comprises the amino acid sequence SGSETPGTSESATPES (SEQ ID NO: 171). In some embodiments, the linker comprises the amino acid sequence SGGSSGGSSGSETPGTSESAT-PESSGGSSGGS (SEQ ID NO: 172). In some embodiments, the linker comprises the amino acid sequence SGGSGGSGGS (SEQ ID NO: 173). In some embodiments, the linker comprises the amino acid sequence SGGS (SEQ ID NO: 174).

Distinguishing features of this aspect include the ability to use previously acquired immune responses to specific amino acid sequences as a means to induce an immune response against otherwise non-immunogenic proteins. Another distinguishing feature is the ability to insert the nucleotide sequences of these immunogenic epitopes in a targets manner that does not induce high levels of unwanted indels as a by-product editing and is efficient in its insertion. This specific application of PE has the ability to combine cell type-specific delivery methods (such as AAV serotypes) to insert epitopes in cell types that are of interest to trigger an immune response to.

Prime editing as a means of inserting immunogenic epitopes into pathogenic genes could be used to program the patient's immune system to fight a wide variety of diseases (not limited to cancer as with immuno-oncology strategies). An immediately relevant use of this technology would be as a cancer therapeutic as it could undermine a tumor's immune escape mechanism by causing an immune response to a relevant oncogene like HER2 or growth factors like EGFR. Such an approach could seem similar to T-cell engineering, but one novel advance of this approach is that it can be utilized in many cell types and for diseases beyond cancer, without needed to generate and introduce engineered T-cells into patients.

Using PE to insert an immunogenicity epitope which most people are already vaccinated against (tetanus, pertussis, diphtheria, measles, mumps, rubella, etc.) into a foreign or endogenous gene that drives a disease, so the patient's immune system learns to disable that protein.

Diseases that stand to have a potential therapeutic benefit from the aforementioned strategy include those caused by aggregation of toxic proteins, such as in fatal familial insomnia. Other diseases that could benefit include those caused by pathogenic overexpression of an otherwise non-toxic endogenous protein, and those caused by foreign pathogens.

Primary therapeutic indications include those mentioned above such as therapeutics for cancer, prion and other neurodegenerative diseases, infectious diseases, and preventative medicine. Secondary therapeutic indications may include preventative care for patients with late-onset genetic diseases. It is expected that current standard of care medicines may be used in conjunction with prime editing for some diseases, like particularly aggressive cancers, or in cases where medications help alleviate disease symptoms until the disease completely cured. Below are examples of immunoepitopes that may be inserted into genes by the herein disclosed prime editors:

| | VACCINE DISEASE | EPITOPE AMINO ACID SEQUENCE | EXAMPLE NUCLEIC ACID SEQUENCE (8) |
|---|---|---|---|
| 1 | TETANUS TOXOID | QYIKANSKFIGITEL (SEQ ID NO: 396) | CATGATATAAAAGCAAATTCTAAATTTA TAGGTATAACTGAACTA (SEQ ID NO: 397) |
| 2 | DIPHTHERIA TOXIN MUTANT CRM197 | GADDVVDSSKSF VMENFSSYHGTK PGYVDSIQKGIQK PKSGTQGNYDDD WKEFYSTDNKYD AAGYSVDNENPL SGKAGGVVKVTY PGLTKVLALKVD NAETIKKELGLSL TEPLMEQVGTEEF IKRFGDGASRVVL SLPFAEGSSSVEYI NNWEQAKALSVE LEINFETRGKRGQ DAMYEYMAQAC AGNRVRRSVGSSL SCINLDWDVIRDK TKTKIESLKEHGPI KNKMSESPNKTV SEEKAKQYLEEFH QTALEHPELSELK TVTGTNPVFAGA NYAAWAVNVAQV IDSETADNLEKTT AALSILPGIGSVM GIADGAVHHNTEE IVAQSIALSSLMVA | GGCGCCGACGACGTGGTGGACAGCAG CAAGAGCTTCGTGATGGAGAACTTCA GCAGCTACCACGGCACCAAGCCCGGC TACGTGGACAGCATCCAGAAGGGCAT CCAGAAGCCCAAGAGCGGCACCCAGG GCAACTACGACGACGACTGGAAGGAG TTCTACAGCACCGACAACAAGTACGA CGCCGCCGGCTACAGCGTGGACAACG AGAACCCCCTGAGCGGCAAGGCCGGC GGCGTGGTGAAGGTGACCTACCCCGG CCTGACCAAGGTGCTGGCCCTGAAGG TGGACAACGCCGAGACCATCAAGAAG GAGCTGGGCCTGAGCCTGACCGAGCC CCTGATGGAGCAGGTGGGCACCGAGG AGTTCATCAAGAGGTTCGGCGACGGC GCCAGCAGGGTGGTGCTGAGCCTGCC CTTCGCCGAGGGCAGCAGCAGCGTGG AGTACATCAACAACTGGGAGCAGGCC AAGGCCCTGAGCGTGGAGCTGGAGAT CAACTTCGAGACCAGGGGCAAGAGGG GCCAGGACGCCATGTACGAGTACATGG CCCAGGCCTGCGCCGGCAACAGGGTG AGGAGGAGCGTGGGCAGCAGCCTGAG CTGCATCAACCTGGACTGGGACGTGAT CAGGGACAAGACCAAGACCAAGATCG AGAGCCTGAAGGAGCACGGCCCCATC AAGAACAAGATGAGCGAGAGCCCCAA |

-continued

| | VACCINE DISEASE | EPITOPE AMINO ACID SEQUENCE | EXAMPLE NUCLEIC ACID SEQUENCE (8) |
|---|---|---|---|
| | | QAIPLVGELVDIGF AAYNFVESIINLFQ VVHNSYNRPAYSP GHKTQPFLHDGY AVSWNTVEDSIIR TGFQGESGHDIKI TAENTPLPIAGVL LPTIPGKLDVNKS KTHISVNGRKIRM RCRAIDGDVTFCR PKSPVYVGNGVH ANLHVAFHRSSSE KIHSNEISSDSIGV LGYQKTVDHTKV NSKLSLFFEIKS (SEQ ID NO: 398) | CAAGACCGTGAGCGAGGAGAAGGCC AAGCAGTACCTGGAGGAGTTCCACCA GACCGCCCTGGAGCACCCCGAGCTGA GCGAGCTGAAGACCGTGACCGGCACC AACCCCGTGTTCGCCGGCGCCAACTA CGCCGCCTGGGCCGTGAACGTGGCCC AGGTGATCGACAGCGAGACCGCCGAC AACCTGGAGAAGACCACCGCCGCCCT GAGCATCCTGCCCGGCATCGGCAGCGT GATGGGCATCGCCGACGGCGCCGTGC ACCACAACACCGAGGAGATCGTGGCC CAGAGCATCGCCCTGAGCAGCCTGAT GGTGGCCCAGGCCATCCCCCTGGTGG GCGAGCTGGTGGACATCGGCTTCGCC GCCTACAACTTCGTGGAGAGCATCATC AACCTGTTCCAGGTGGTGCACAACAG CTACAACAGGCCCGCCTACAGCCCCG GCCACAAGACCCAGCCCTTCCTGCAC GACGGCTACGCCGTGAGCTGGAACAC CGTGGAGGACAGCATCATCAGGACCG GCTTCCAGGGCGAGAGCGGCCACGAC ATCAAGATCACCGCCGAGAACACCCC CCTGCCCATCGCCGGCGTGCTGCTGCC CACCATCCCCGGCAAGCTGGACGTGA ACAAGAGCAAGACCCACATCAGCGTG AACGGCAGGAAGATCAGGATGAGGTG CAGGGCCATCGACGGCGACGTGACCT TCTGCAGGCCCAAGAGCCCCGTGTAC GTGGGCAACGGCGTGCACGCCAACCT GCACGTGGCCTTCCACAGGAGCAGCA GCGAGAAGATCCACAGCAACGAGATC AGCAGCGACAGCATCGGCGTGCTGGG CTACCAGAAGACCGTGGACCACACCA AGGTGAACAGCAAGCTGAGCCTGTTC TTCGAGATCAAGAGC (SEQ ID NO: 399) |
| 3 | MUMPS IMMUNO-EPITOPE 1 | GTYRLIPNARANL TA (SEQ ID NO: 400) | GGCACCTACAGGCTGATCCCCAACGC CAGGGCCAACCTGACCGCC (SEQ ID NO: 401) |
| 4 | MUMPS IMMUNO-EPITOPE 2 MUMPS IMMUNO-EPITOPE 1 | PSKFFTISDSATFA PGPVSNA (SEQ ID NO: 402) PSKLFIMLDNATF APGPVVNA (SEQ ID NO: 404) | CCGAGCAAATTTTTTACCATTAGCGAT AGCGCGACCTTTGCGCCGGGCCCGGT GAGCAACGCG (SEQ ID NO: 403) CCGAGCAAACTGTTTATTATGCTGGAT AACGCGACCTTTGCGCCGGGCCCGGT GGTGAACGCG (SEQ ID NO: 405) SELECTED EXAMPLES FROM HEMAGGLUTININ-NEURAMINIDASE (HN) DIVERSITY AMONG OUTBREAK STRAINS (TABLE 1) DIVERGENCE BETWEEN VACCINE STRAIN JL5 AND OUTBREAK STRAINS (TABLE 2) |
| 5 | RUBELLA VIRUS (RV) | TPPPYQVSCGGES DRASARVIDPAAQS (SEQ ID NO: 406) | ACCCCCCCCCCCTACCAGGTGAGCTGC GGCGGCGAGAGCGACAGGGCCAGCG CCAGGGTGATCGACCCCGCCGCCCAG AGC (SEQ ID NO: 407) |
| 6 | HEMAG-GLUTININ | PEYAYKIVKNKK MEDGFLQGMVD GWYGHHSNEQGS GLMENERTLDKA NPNNDLCSWSDH EASSNNTNQEDLL QRESRRKKRIGTS TLNQRGNCNTKC QTEEARLKREEVS LVKSDQCSNGSLQ CRANNSTEQVD (SEQ ID NO: 408) | CCCGAGTACGCCTACAAGATCGTGAA GAACAAGAAGATGGAGGACGGCTTCC TGCAGGGCATGGTGGACGGCTGGTAC GGCCACCACAGCAACGAGCAGGGCAG CGGCCTGATGGAGAACGAGAGGACCC TGGACAAGGCCAACCCCAACAACGAC CTGTGCAGCTGGAGCGACCACGAGGC CAGCAGCAACAACACCAACCAGGAGG ACCTGCTGCAGGGGAGAGCAGGAGG AAGAAGAGGATCGGCACCAGCACCCT GAACCAGAGGGGCAACTGCAACACCA AGTGCCAGACCGAGGAGGCCAGGCTG AAGAGGGAGGAGGTGAGCCTGGTGA AGAGCGACCAGTGCAGCAACGGCAGC CTGCAGTGCAGGGCCAACAACAGCAC CGAGCAGGTGGAC (SEQ ID NO: 409) |

-continued

| VACCINE | DISEASE | EPITOPE AMINO ACID SEQUENCE | EXAMPLE NUCLEIC ACID SEQUENCE (8) |
|---|---|---|---|
| 7 | NEURAMINI-DASE | TKSTNSRSGGISG PDNEAPVGEAPSP YGDNPRPNDGNN IRIGSKGYNGIITD TIEESCSCYPDAK VVKSVELDSTIWT SGSSPNQKIITIGW DPNGWTGTPMSP NGAYGTDGPSNG QANQHQAESISA GNSSLCPIRDNWH GSNRSWSWPDGAE (SEQ ID NO: 410) | ACCAAGAGCACCAACAGCAGGAGCG GCGGCATCAGCGGCCCCGACAACGAG GCCCCCGTGGGCGAGGCCCCCAGCCC CTACGGCGACAACCCCAGGCCCAACG ACGGCAACAACATCAGGATCGGCAGC AAGGGCTACAACGGCATCATCACCGA CACCATCGAGGAGAGCTGCAGCTGCT ACCCCGACGCCAAGGTGGTGAAGAGC GTGGAGCTGGACAGCACCATCTGGAC CAGCGGCAGCAGCCCCAACCAGAAGA TCATCACCATCGGCTGGGACCCCAACG GCTGGACCGGCACCCCCATGAGCCCC AACGGCGCCTACGGCACCGACGGCCC CAGCAACGGCCAGGCCAACCAGCACC AGGCCGAGAGCATCAGCGCCGGCAAC AGCAGCCTGTGCCCCATCAGGGACAA CTGGCACGGCAGCAACAGGAGCTGGA GCTGGCCCGACGGCGCCGAG (SEQ ID NO: 411) |
| 8 | TAP1 (TRANS-PORT ANTIGEN PRESENTA-TION) ON H5N1 VIRUS HEMAG-GLUTININ | EKIVLLLAMMEKI VLLLAKCQTPMG AIKAVDGVTNKCP YLGSPSF (SEQ ID NO: 412) | GAGAAGATCGTGCTGCTGCTGGCCATG ATGGAGAAGATCGTGCTGCTGCTGGCC AAGTGCCAGACCCCCATGGGCGCCAT CAAGGCCGTGGACGGCGTGACCAACA AGTGCCCCTACCTGGGCAGCCCCAGC TTC (SEQ ID NO: 413) |
| 9 | TAP2 (TRANS-PORT ANTIGEN PRESENTA-TION) ON H5N1 VIRUS NEURAMINI-DASE | IRPCFWVELNPNQ KIITIRPCFWVELI CYPDAGEIT (SEQ ID NO: 414) | ATCAGGCCCTGCTTCTGGGTGGAGCTG AACCCCAACCAGAAGATCATCACCATC AGGCCCTGCTTCTGGGTGGAGCTGATC TGCTACCCCGACGCCGGCGAGATCACC (SEQ ID NO: 415) |
| 10 | HEMAG-GLUTININ EPITOPES TOWARD CLASS I HLA | MEKIVLLLAEKIV LLLAMCPYLGSPS FKCQTPMGAIKAV DGVTNK (SEQ ID NO: 416) | ATGGAGAAGATCGTGCTGCTGCTGGCC GAGAAGATCGTGCTGCTGCTGGCCATG TGCCCCTACCTGGGCAGCCCCAGCTTC AAGTGCCAGACCCCCATGGGCGCCAT CAAGGCCGTGGACGGCGTGACCAACA AG (SEQ ID NO: 417) |
| 11 | NEURAMINI-DASE EPITOPES TOWARD CLASS I HLA | NPNQKIITICYPDAG EITIRPCFWVELRPC FWVELI (SEQ ID NO: 418) | AACCCCAACCAGAAGATCATCACCATCT GCTACCCCGACGCCGGCGAGATCACCAT CAGGCCCTGCTTCTGGGTGGAGCTGAGG GCCCTGCTTCTGGGTGGAGCTGATC (SEQ ID NO: 419) |
| 12 | HEMAG-GLUTININ EPITOPES TOWARD CLASS II HLA | MVSLVKSDQIGTST LNQR (SEQ ID NO: 420) | ATGGTGAGCCTGGTGAAGAGCGACCAG ATCGGCACCAGCACCCTGAACCAGAGG (SEQ ID NO: 421) |
| 13 | NEURAMINI-DASE EPITOPES TOWARD CLASS II HLA | YNGIITDTI (SEQ ID NO: 422) | TACAACGGCATCATCACCGACACCATC (SEQ ID NO: 423) |
| 14 | HEMAG-GLUTININ EPITOPE H5N1- | MEKIVLLLAEKIVL LLAMMVSLVKSDQ CPYLGSPSFIGTSTL NQRKCQTPMGAIK | ATGGAGAAGATCGTGCTGCTGCTGGCC GAGAAGATCGTGCTGCTGCTGGCCATG ATGGTGAGCCTGGTGAAGAGCGACCAG TGCCCCTACCTGGGCAGCCCCAGCTTC |

| VACCINE | DISEASE | EPITOPE AMINO ACID SEQUENCE | EXAMPLE NUCLEIC ACID SEQUENCE (8) |
|---|---|---|---|
| | BOUND CLASS I AND CLASS II HLA | AVDGVTNK (SEQ ID NO: 424) | ATCGGCACCAGCACCCTGAACCAGAGG (SEQ ID NO: 425) |
| 15 | NEURAMINI- DASE EPITOPE H5N1- BOUND CLASS I AND CLASS II HLA | NPNQKIITIYNGIIT DTICYPDAGEITIRP CFWVELRPCFWVELI (SEQ ID NO: 426) | AACCCCAACCAGAAGATCATCACCATCT ACAACGGCATCATCACCGACACCATCTG CTACCCCGACGCCGGCGAGATCACCATC AGGCCCTGCTTCTGGGTGGAGCTGAGG CCCTGCTTCTGGGTGGAGCTGATC (SEQ ID NO: 427) |

Additional immunoepitopes may also be installed which are known in the art. Any of the immunoepitopes available from the Immune Epitope Database and Analysis Resource (iedb.org/epitopedetails_v3.php) (the contents of which are incorporated herein by reference) may be installed by the prime editors disclosed herein.

In some embodiments, the immunoepitopes which may be installed by the prime editors disclosed herein may include any of the following epitopes:

| NO. | DISEASE | EPITOPE AMINO ACID SEQUENCE | SEQ ID NO | ACCESS. NO. |
|---|---|---|---|---|
| 1 | TETANUS TOXOID | QYIKANSKFIGITEL | 396 | NA |
| 2 | DIPHTHERIA TOXIN MUTANT CRM197 | GADDVVDSSKSFVMENFSSYHGTKP GYVDSIQKGIQKPKSGTQGNYDDDW KEFYSTDNKYDAAGYSVDNENPLSG KAGGVVKVTYPGLTKVLALKVDNA ETIKKELGLSLTEPLMEQVGTEEFIKR FGDGASRVVLSLPFAEGSSSVEYINN WEQAKALSVELEINFETRGKRGQDA MYEYMAQACAGNRVRRSVGSSLSCI NLDWDVIRDKTKTKIESLKEHGPIKN KMSESPNKTVSEEKAKQYLEEFHQT ALEHPELSELKTVTGTNPVFAGANYA AWAVNVAQVIDSETADNLEKTTAALS ILPGIGSVMGIADGAVHHNTEEIVAQS IALSSLMVAQAIPLVGELVDIGFAAYN FVESIINLFQVVHNSYNRPAYSPGHKT QPFLHDGYAVSWNTVEDSIIRTGFQG ESGHDIKITAENTPLPIAGVLLPTIPGK LDVNKSKTHISVNGRKIRMRCRAIDG DVTFCRPKSPVYVGNGVHANLHVAF HRSSSEKIHSNEISSDSIGVLGYQKTV DHTKVNSKLSLFFEIKS | 428 | NA |
| 3 | MUMPS | GTYRLIPNARANLTA | 400 | NA |
| 4 | MUMPS | PSKFFTISDSATFAPGPVSNA; PSKLFIMLDNATFAPGPVVNA | 402; 404 | NA |
| 5 | RUBELLA VIRUS (RV) | TPPPYQVSCGGESDRASARVIDPAAQS | 406 | NA |
| 6 | HEMAGGLUTININ | PEYAYKIVKNKKMEDGFLQGMVDG WYGHHSNEQGSGLMENERTLDKAN PNNDLCSWSDHEASSNNTNQEDLLQ RESRRKKRIGTSTLNQRGNCNTKCQT EEARLKREEVSLVKSDQCSNGSLQCR ANNSTEQVD | 408 | NA |
| 7 | NEURAMINIDASE | TKSTNSRSGGISGPDNEAPVGEAPSP YGDNPRPNDGNNIRIGSKGYNGIITD TIEESCSCYPDAKVVKSVELDSTIWTS GSSPNQKIITIGWDPNGWTGTPMSPN GAYGTDGPSNGQANQHQAESISAGN SSLCPIRDNWHGSNRSWSWPDGAE | 410 | NA |

| NO. | DISEASE | EPITOPE AMINO ACID SEQUENCE | SEQ ID NO | ACCESS. NO. |
|---|---|---|---|---|
| 8 | TAP (TRANSPORT ANTIGEN PRESENTATION) ON H5N1 VIRUS HEMAGGLUTININ | EKIVLLLAMMEKIVLLLAKCQTPMG AIKAVDGVTNKCPYLGSPSF | 412 | NA |
| 9 | TAP (TRANSPORT ANTIGEN PRESENTATION) ON H5N1 VIRUS NEURAMINIDASE | IRPCFWVELNPNQKIITIRPCFWVELIC YPDAGEIT | 414 | NA |
| 10 | HEMAGGLUTININ EPITOPES TOWARD CLASS I HLA | MEKIVLLLAEKIVLLLAMCPYLGSPS FKCQTPMGAIKAVDGVTNK | 416 | NA |
| 11 | NEURAMINIDASE EPITOPES TOWARD CLASS I HLA | NPNQKIITICYPDAGEITIRPCFWVELR PCFWVELI | 418 | NA |
| 12 | HEMAGGLUTININ EPITOPES TOWARD CLASS II HLA | MVSLVKSDQIGTSTLNQR | 420 | NA |
| 13 | NEURAMINIDASE EPITOPES TOWARD CLASS II HLA | YNGIITDTI | 422 | NA |
| 14 | HEMAGGLUTININ EPITOPE H5N1-BOUND CLASS I AND CLASS II HLA | MEKIVLLLAEKIVLLLAMMVSLVKSD QCPYLGSPSFIGTSTLNQRKCQTPMG AIKAVDGVTNK | 424 | NA |
| 15 | NEURAMINIDASE EPITOPE H5N1-BOUND CLASS I AND CLASS II HLA | NPNQKIITIYNGIITDTICYPDAGEITIR PCFWVELRPCFWVELI | 426 | NA |
| 16 | CORYNEBACTERIUM DIPHTHERIAE | AACAGNRVRRSVGSSLKC | 899 | SRC280292 |
| 17 | MEASLES VIRUS STRAIN EDMONSTON | AADHCPVVEVNGVTI | 900 | P69353.1 |
| 18 | MEASLES VIRUS STRAIN EDMONSTON | AAHLPTGTPLDID | 901 | P04851.1 |
| 19 | BORDETELLA PERTUSSIS | AALAVWAGLAVQ | 902 | Q00879.1 |
| 20 | MEASLES VIRUS STRAIN EDMONSTON | AALGVATAAQITAGI | 903 | P69353.1 |
| 21 | RUBELLA VIRUS STRAIN THERIEN | AALLNTPPPYQVSCGGESDRATAR | 904 | P07566.1 |
| 22 | RUBELLA VIRUS | AAQSFTGVVYGTHTT | 905 | BAA28178.1 |
| 23 | RUBELLA VIRUS | ACEVEPAFGHSDAAC | 906 | BAA28178.1 |
| 24 | RUBELLA VIRUS | ACTFWAVNAYSSGGY | 907 | BAA28178.1 |
| 25 | RUBELLA VIRUS | ADDPLLR | 908 | BAA19893.1 |
| 26 | RUBELLA VIRUS | ADDPLLRT | 909 | CAJ88851.1 |

| NO. | DISEASE | EPITOPE AMINO ACID SEQUENCE | SEQ ID NO | ACCESS. NO. |
|---|---|---|---|---|
| 27 | MEASLES VIRUS STRAIN EDMONSTON | AEMICDIDTYIVEAG | 910 | P04851.1 |
| 28 | MEASLES VIRUS STRAIN EDMONSTON | AEMICDIDTYIVEAGLASFI | 911 | P04851.1 |
| 29 | MEASLES VIRUS STRAIN EDMONSTON | AEPLLSC | 912 | P04851.1 |
| 30 | BORDETELLA PERTUSSIS | AFVSTSSSRRYTEVY | 913 | CAD44970.1 |
| 31 | BORDETELLA PERTUSSIS | AGFIYRETFCITTIYKTGQPAADHYYSKVTA | 914 | P04979.1 |
| 32 | RUBELLA VIRUS | AGLLACCAKCLYYLR | 915 | BAA28178.1 |
| 33 | RUBELLA VIRUS | AHTTSDPWHPPG | 916 | BAA19893.1 |
| 34 | MEASLES VIRUS STRAIN EDMONSTON | AIAKLEDAKELLESS | 917 | P69353.1 |
| 35 | MEASLES VIRUS STRAIN EDMONSTON | AIDNLRASLETTNQA | 918 | P69353.1 |
| 36 | BORDETELLA PERTUSSIS | AKGVEFR | 919 | ACI16088.1 |
| 37 | MEASLES VIRUS STRAIN EDMONSTON | AKWAVPTTRTDDKLR | 920 | P08362.1 |
| 38 | MEASLES VIRUS STRAIN EDMONSTON | ALAEVLKKPV | 921 | ABO69699.1 |
| 39 | MEASLES VIRUS STRAIN EDMONSTON | ALGVINTLEWIPRFK | 922 | P08362.1 |
| 40 | MEASLES VIRUS STRAIN EDMONSTON | ALHQSMLNSQAIDNL | 923 | P69353.1 |
| 41 | MEASLES VIRUS STRAIN EDMONSTON | ALIGILSLFV | 924 | ABI54110.1 |
| 42 | RUBELLA VIRUS | ALLNTPPPYQVSCGGESDRA | 925 | CAJ88851.1 |
| 43 | RUBELLA VIRUS STRAIN M33 | ALLNTPPPYQVSCGGESDRASARV | 926 | CAJ88851.1 |
| 44 | RUBELLA VIRUS | ALVEGLAPGGGNCHL | 927 | BAA28178.1 |
| 45 | BORDETELLA PERTUSSIS | AMAAWSERAGEA | 928 | P04977.1 |
| 46 | MEASLES VIRUS STRAIN EDMONSTON | ANCASILCKCYTTGT | 929 | P69353.1 |
| 47 | BORDETELLA PERTUSSIS | ANPNPYTSRRSV | 930 | P04977.1 |
| 48 | RUBELLA VIRUS | APGPGEVW | 931 | CAJ88851.1 |
| 49 | RUBELLA VIRUS | APLPPHTTERIETRSARHPWRIR | 932 | ABD64214.1 |

-continued

| NO. | DISEASE | EPITOPE AMINO ACID SEQUENCE | SEQ ID NO | ACCESS. NO. |
|---|---|---|---|---|
| 50 | RUBELLA VIRUS VACCINE STRAIN RA27/3 | APPMPPQPPRAHGQHYGHHHHQLPF LG | 933 | CAA33016.1 |
| 51 | RUBELLA VIRUS STRAIN THERIEN | APPTLPQPPCAHGQHYGHHHHQLPF LG | 934 | P07566.1 |
| 52 | RUBELLA VIRUS | APPTLPQPPRAHGQHYGHHHHQLPF LG | 935 | ABD64214.1 |
| 53 | BORDETELLA PERTUSSIS | APQPGPQPPQPPQPQPEAPAPQ | 936 | P14283.3 |
| 54 | RUBELLA VIRUS | AQLASYFNPGGSYYK | 937 | BAA28178.1 |
| 55 | MEASLES VIRUS STRAIN EDMONSTON | ARAAHLPTGTPLD | 938 | P04851.1 |
| 56 | MEASLES VIRUS STRAIN EDMONSTON | ARLVSEIAMHTTEDK | 939 | P04851.1 |
| 57 | MEASLES VIRUS STRAIN EDMONSTON | ARLVSEIAMHTTEDKISRAV | 940 | P04851.1 |
| 58 | MEASLES VIRUS STRAIN EDMONSTON-B | ASDVETAEGGEIHELLR | 941 | P03422.1 |
| 59 | MEASLES MORBILLIVIRUS | ASDVETAEGGEIHELLRLQ | 942 | ABO69699.1 |
| 60 | MEASLES VIRUS STRAIN EDMONSTON-B | ASDVETAEGGEIHELLRLQSR | 943 | P03422.1 |
| 61 | MEASLES MORBILLIVIRUS | ASDVETAEGGEIHKLLRLQ | 944 | AAA63285.1 |
| 62 | RUBELLA VIRUS STRAIN M33 | ASDVLPGHWLQG | 945 | NP_740663.1 |
| 63 | MEASLES VIRUS STRAIN EDMONSTON | ASELGITAEDARLVS | 946 | P04851.1 |
| 64 | MEASLES VIRUS STRAIN EDMONSTON | ASELGITAEDARLVSEIAMH | 947 | P04851.1 |
| 65 | MEASLES VIRUS STRAIN EDMONSTON | ASESSQDPQDSRR | 948 | P04851.1 |
| 66 | MEASLES VIRUS STRAIN EDMONSTON | ASILCKCYTTGTIIN | 949 | P69353.1 |
| 67 | RUBELLA VIRUS | ASPVCQRHSPDCSRL | 950 | BAA28178.1 |
| 68 | BORDETELLA PERTUSSIS | ASQARWTGATRA | 951 | BAF35031.1 |
| 69 | RUBELLA VIRUS STRAIN THERIEN | ASYFNPGGSYYKQYHPTACEVEPAFG HS | 952 | P07566.1 |
| 70 | MEASLES VIRUS STRAIN EDMONSTON | ASYKVMTRSSHQSLV | 953 | P69353.1 |
| 71 | BORDETELLA PERTUSSIS | ASYVKKPKEDVD | 954 | ACI16088.1 |

-continued

| NO. | DISEASE | EPITOPE AMINO ACID SEQUENCE | SEQ ID NO | ACCESS. NO. |
|---|---|---|---|---|
| 72 | MEASLES VIRUS STRAIN EDMONSTON | ATAAQITAGIALHQS | 955 | P69353.1 |
| 73 | RUBELLA VIRUS | ATPERPRL | 956 | CAJ88851.1 |
| 74 | MEASLES VIRUS STRAIN EDMONSTON | AVCLGGLIGIPALIC | 957 | P69353.1 |
| 75 | MEASLES VIRUS STRAIN EDMONSTON | AVGPRQAQVSF | 958 | P04851.1 |
| 76 | RUBELLA VIRUS | AVNAYSSGGYAQLAS | 959 | BAA28178.1 |
| 77 | RUBELLA VIRUS | AVSETRQTWAEWAAA | 960 | BAA28178.1 |
| 78 | MEASLES VIRUS STRAIN EDMONSTON | AVTAPDTAADSELRR | 961 | P04851.1 |
| 79 | MEASLES VIRUS STRAIN EDMONSTON | AVTAPDTAADSELRRWIKYT | 962 | P04851.1 |
| 80 | BORDETELLA PERTUSSIS | AYGGIIKDAPPGAGFIYRETFC | 963 | P04979.1 |
| 81 | RUBELLA VIRUS | CALPLAGLLACCAKC | 964 | BAA28178.1 |
| 82 | RUBELLA VIRUS | CARIWNGTQRACTFW | 965 | BAA28178.1 |
| 83 | MEASLES VIRUS STRAIN EDMONSTON | CARTLVSGSFGNRFI | 966 | P69353.1 |
| 84 | BORDETELLA PERTUSSIS | CASPYEGRYRDMYDALRBRLLY | 967 | SRC280066 |
| 85 | BORDETELLA PERTUSSIS | CAVFVRSGQPVIGA | 968 | AAA83981.1 |
| 86 | RUBELLA VIRUS | CCAKCLYYLRGAIAPR | 969 | BAA28178.1 |
| 87 | MEASLES VIRUS STRAIN EDMONSTON | CCRGRCNKKGEQVGM | 970 | P69353.1 |
| 88 | RUBELLA VIRUS | CEIPTDVSCEGLGAW | 971 | BAA28178.1 |
| 89 | BORDETELLA PERTUSSIS | CFGKDLKRPGSSPMEV | 972 | P0A3R5.1 |
| 90 | MEASLES MORBILLIVIRUS | CFQQACKGKIQALCE | 973 | P06830.1 |
| 91 | MEASLES MORBILLIVIRUS | CFQQACKGKIQALCENPEWAPLKDNRIPS | 974 | AAR89413.1 |
| 92 | RUBELLA VIRUS | CGGESDRASARVIDP | 975 | BAA28178.1 |
| 93 | BORDETELLA PERTUSSIS | CITTIYKTGQPAADHYYSKVTA | 976 | P04979.1 |
| 94 | MEASLES MORBILLIVIRUS | CKGKIQALCENPEWA | 977 | AAR89413.1 |
| 95 | MEASLES VIRUS STRAIN EDMONSTON | CKPWQESRKNKAQ | 978 | P04851.1 |
| 96 | MEASLES VIRUS STRAIN EDMONSTON | CNKKGEQVGMSRPGL | 979 | P69353.1 |

| NO. | DISEASE | EPITOPE AMINO ACID SEQUENCE | SEQ ID NO | ACCESS. NO. |
| --- | --- | --- | --- | --- |
| 97 | RUBELLA VIRUS | CNVTTEHPFCNTPHG | 980 | BAA28178.1 |
| 98 | BORDETELLA PERTUSSIS | CQVGSSNSAF | 981 | P04977.1 |
| 99 | MEASLES MORBILLIVIRUS | CSGPTTIRGQFS | 982 | P08362.1 |
| 100 | BORDETELLA PERTUSSIS | CTSPYDGKYWSMYSRL | 983 | AAA83981.1 |
| 101 | MEASLES VIRUS STRAIN EDMONSTON | CVLADSESGGHITHS | 984 | P08362.1 |
| 102 | MEASLES MORBILLIVIRUS | CYTTGTIINQDPDKILTYIAADHC | 985 | AAF02706.1 |
| 103 | RUBELLA VIRUS | DADDPLLR | 986 | CAJ88851.1 |
| 104 | MEASLES VIRUS STRAIN EDMONSTON | DARAAHLPTGTPLDI | 987 | P04851.1 |
| 105 | MEASLES VIRUS STRAIN EDMONSTON | DARAAHLPTGTPLDIDTASE | 988 | P04851.1 |
| 106 | MEASLES VIRUS STRAIN EDMONSTON | DCHAPTYLPAEVDGD | 989 | P08362.1 |
| 107 | RUBELLA VIRUS | DCSRLVGATPERPRL | 990 | BAA28178.1 |
| 108 | MEASLES VIRUS STRAIN EDMONSTON | DDKLRMETCFQQACK | 991 | P08362.1 |
| 109 | RUBELLA VIRUS | DDPLLRTA | 992 | CAJ88851.1 |
| 110 | RUBELLA VIRUS | DDPLLRTAPGPGEVW | 993 | BAA28178.1 |
| 111 | BORDETELLA PERTUSSIS | DDPPATVYRYD | 994 | P04977.1 |
| 112 | BORDETELLA PERTUSSIS | DDPPATVYRYDSRPPED | 995 | CAD44970.1 |
| 113 | BORDETELLA PERTUSSIS | DDPPATVYRYDSRPPEDV | 996 | ACI04548.1 |
| 114 | MEASLES MORBILLIVIRUS | DEVGLRTPQRFTDLV | 997 | P06830.1 |
| 115 | MEASLES VIRUS STRAIN EDMONSTON | DHCPVVEVNGVTIQV | 998 | P69353.1 |
| 116 | MEASLES VIRUS STRAIN EDMONSTON | DIDTASESSQDPQ | 999 | P04851.1 |
| 117 | MEASLES VIRUS STRAIN EDMONSTON | DINKVLEKLGYSGGD | 1000 | P69353.1 |
| 118 | BORDETELLA PERTUSSIS | DLIAYKQ | 1001 | ACI16088.1 |
| 119 | MEASLES VIRUS STRAIN EDMONSTON | DLIGQKLGLKLLRYY | 1002 | P69353.1 |
| 120 | RUBELLA VIRUS | DLQKALEAQSRALRAELAA | 1003 | P07566.1 |

-continued

| NO. | DISEASE | EPITOPE AMINO ACID SEQUENCE | SEQ ID NO | ACCESS. NO. |
|---|---|---|---|---|
| 121 | MEASLES MORBILLIVIRUS | DLQYVLATYDTSRVE | 1004 | P06830.1 |
| 122 | MEASLES VIRUS STRAIN EDMONSTON | DLSLRRFMV | 1005 | P04851.1 |
| 123 | MEASLES VIRUS STRAIN EDMONSTON | DLSNCMVALGELKLA | 1006 | P08362.1 |
| 124 | RUBELLA VIRUS | DLVEYIMNYTGNQQSRWGLGSPNC | 1007 | CAJ88851.1 |
| 125 | MEASLES MORBILLIVIRUS | DLVKFISDKIKFLNP | 1008 | AAR89413.1 |
| 126 | MEASLES MORBILLIVIRUS | DLVKFISTKIKFLNP | 1009 | SRC280117 |
| 127 | MEASLES VIRUS STRAIN EDMONSTON | DLYKSNHNNV | 1010 | P08362.1 |
| 128 | BORDETELLA PERTUSSIS | DNVLDHLTGR | 1011 | ACI04548.1 |
| 129 | BORDETELLA PERTUSSIS | DNVLDHLTGRSC | 1012 | P04977.1 |
| 130 | BORDETELLA PERTUSSIS | DNVLDHLTGRSCQ | 1013 | P04977.1 |
| 131 | MEASLES MORBILLIVIRUS | DPDKILTYIAA | 1014 | AAF02706.1 |
| 132 | RUBELLA VIRUS STRAIN THERIEN | DPGDLVEYIMNYTGNQQSR | 1015 | P07566.1 |
| 133 | RUBELLA VIRUS | DPLLRTAP | 1016 | CAJ88851.1 |
| 134 | RUBELLA VIRUS | DPLLRTAPGPGEVWVTPVIGSQ | 1017 | CAJ88851.1 |
| 135 | MEASLES VIRUS STRAIN EDMONSTON | DPQDSRRSAEPLL | 1018 | P04851.1 |
| 136 | MEASLES VIRUS STRAIN EDMONSTON | DPVIDRLYLSSHRGV | 1019 | P08362.1 |
| 137 | MEASLES VIRUS STRAIN EDMONSTON | DQILRSMKGLSSTSI | 1020 | P69353.1 |
| 138 | MEASLES MORBILLIVIRUS | DQYCADVAAEELMNA | 1021 | P06830.1 |
| 139 | MEASLES VIRUS STRAIN EDMONSTON | DSESGGHITH | 1022 | P08362.1 |
| 140 | MEASLES VIRUS STRAIN EDMONSTON | DTASESSQDPQDS | 1023 | P04851.1 |
| 141 | RUBELLA VIRUS | DTVMSVFALASYVQH | 1024 | BAA28178.1 |
| 142 | BORDETELLA PERTUSSIS | DVFQNGFTAWGNND | 1025 | P04977.1 |
| 143 | RUBELLA VIRUS | DVGAVPPGKFVTAAL | 1026 | BAA28178.1 |
| 144 | CORYNEBACTERIUM DIPHTHERIAE | DVNKSKTHISVNGRKI | 1027 | CAE11230.1 |

-continued

| NO. | DISEASE | EPITOPE AMINO ACID SEQUENCE | SEQ ID NO | ACCESS. NO. |
|---|---|---|---|---|
| 145 | RUBELLA VIRUS | DVSCEGLGAWVPAAP | 1028 | BAA28178.1 |
| 146 | RUBELLA VIRUS STRAIN THERIEN | DWASPVCQRHSPDCSRLVGATPERPRL | 1029 | P07566.1 |
| 147 | MEASLES VIRUS STRAIN EDMONSTON | EARESYRETGPSR | 1030 | P04851.1 |
| 148 | BORDETELLA PERTUSSIS | EAVEAERAGRGTG | 1031 | ACI04548.1 |
| 149 | MEASLES VIRUS STRAIN EDMONSTON | EDAKELLESSDQILR | 1032 | P69353.1 |
| 150 | MEASLES VIRUS STRAIN EDMONSTON | EDRRVKQSRGEAR | 1033 | P04851.1 |
| 151 | MEASLES VIRUS STRAIN EDMONSTON | EDSITIPYQGSGKGV | 1034 | P08362.1 |
| 152 | RUBELLA VIRUS | EEAFTYLCTAPGCAT | 1035 | BAA28178.1 |
| 153 | MEASLES VIRUS STRAIN EDMONSTON | EGFNMILGTILAQIW | 1036 | P04851.1 |
| 154 | MEASLES VIRUS STRAIN EDMONSTON | EGFNMILGTILAQIWVLLAK | 1037 | P04851.1 |
| 155 | RUBELLA VIRUS | EHPFCNTPHGQLEVQ | 1038 | BAA28178.1 |
| 156 | MEASLES VIRUS STRAIN EDMONSTON | EISDIEVQDPEGFNM | 1039 | P04851.1 |
| 157 | MEASLES VIRUS STRAIN EDMONSTON | EISDIEVQDPEGFNMILGTI | 1040 | P04851.1 |
| 158 | MEASLES VIRUS STRAIN EDMONSTON | EKPNLSSKRSE | 1041 | P08362.1 |
| 159 | MEASLES VIRUS STRAIN EDMONSTON | ELKLAALCHGEDSIT | 1042 | P08362.1 |
| 160 | MEASLES MORBILLIVIRUS | ELMNALVNSTLLETR | 1043 | P06830.1 |
| 161 | MEASLES VIRUS STRAIN EDMONSTON | ELPRL | 1044 | P04851.1 |
| 162 | MEASLES MORBILLIVIRUS | ENPEWAPLKDNRIPSYGVLSVDL | 1045 | AAR89413.1 |
| 163 | MEASLES VIRUS STRAIN EDMONSTON | EPIRDALNAMTQNIR | 1046 | P69353.1 |
| 164 | MEASLES VIRUS STRAIN EDMONSTON | EQVGMSRPGLKPDLT | 1047 | P69353.1 |
| 165 | RUBELLA VIRUS | ERPRLRLV | 1048 | CAJ88851.1 |
| 166 | RUBELLA VIRUS | ERPRLRLVDADDPLL | 1049 | BAA28178.1 |
| 167 | MEASLES VIRUS CAM/RB | ESPGQLIQRITDDPDVS | 1050 | P04851.1 |

-continued

| NO. | DISEASE | EPITOPE AMINO ACID SEQUENCE | SEQ ID NO | ACCESS. NO. |
|---|---|---|---|---|
| 168 | MEASLES VIRUS STRAIN EDMONSTON | ESRGIKARITHVDTE | 1051 | P69353.1 |
| 169 | MEASLES VIRUS STRAIN EDMONSTON | ESSCTFMPEGTVCSQ | 1052 | P69353.1 |
| 170 | MEASLES VIRUS STRAIN EDMONSTON | ESSQDPQDSRRSA | 1053 | P04851.1 |
| 171 | MEASLES VIRUS STRAIN EDMONSTON | ETRTTNQFLAVSKGN | 1054 | P08362.1 |
| 172 | MEASLES VIRUS STRAIN EDMONSTON | EVDGDVKLSSNLVIL | 1055 | P08362.1 |
| 173 | MEASLES VIRUS STRAIN EDMONSTON-B | EVNGVTIQV | 1056 | P26031.1 |
| 174 | RUBELLA VIRUS | EVWVTPVI | 1057 | CAJ88851.1 |
| 175 | RUBELLA VIRUS | EVWVTPVIGSQA | 1058 | BAA19893.1 |
| 176 | RUBELLA VIRUS | EWAAAHWWQLTLGAT | 1059 | BAA28178.1 |
| 177 | MEASLES MORBILLIVIRUS | EWIPRFKVSPYLFTV | 1060 | P06830.1 |
| 178 | BORDETELLA PERTUSSIS | FEYVDTYGDNAG | 1061 | P04977.1 |
| 179 | MEASLES MORBILLIVIRUS | FGPLITHGSGMDLYK | 1062 | P06830.1 |
| 180 | MEASLES VIRUS STRAIN EDMONSTON | FIFDALAEV | 1063 | ABK40531.1 |
| 181 | MEASLES VIRUS STRAIN EDMONSTON | FISDKIKFL | 1064 | P08362.1 |
| 182 | MEASLES VIRUS STRAIN EDMONSTON | FKRNKDKPPITSGSG | 1065 | P04851.1 |
| 183 | MEASLES VIRUS STRAIN EDMONSTON | FKRNKDKPPITSGSGGAIRG | 1066 | P04851.1 |
| 184 | RUBELLA VIRUS | FKTVRPVALPRTLAP | 1067 | BAA28178.1 |
| 185 | MEASLES VIRUS STRAIN EDMONSTON | FLMDRHIIV | 1068 | ABK40531.1 |
| 186 | MEASLES VIRUS STRAIN EDMONSTON | FMAVLLTLQTPTGQI | 1069 | P69353.1 |
| 187 | MEASLES VIRUS STRAIN EDMONSTON | FMPEGTVCSQNALYP | 1070 | P69353.1 |
| 188 | MEASLES MORBILLIVIRUS | FMYMSLLGV | 1071 | AAN09804.1 |
| 189 | MEASLES VIRUS STRAIN EDMONSTON | FNVPIKEAGEDCHAP | 1072 | P08362.1 |

-continued

| NO. | DISEASE | EPITOPE AMINO ACID SEQUENCE | SEQ ID NO | ACCESS. NO. |
|---|---|---|---|---|
| 190 | MEASLES MORBILLIVIRUS | FRDLTWCINPPERIK | 1073 | AAC35876.2 |
| 191 | MEASLES VIRUS STRAIN EDMONSTON | FSHDDPISSDQSRFG | 1074 | P04851.1 |
| 192 | MEASLES VIRUS STRAIN EDMONSTON | FSHDDPISSDQSRFGWFENK | 1075 | P04851.1 |
| 193 | MEASLES MORBILLIVIRUS | FTDLVKFISDKIKFL | 1076 | P06830.1 |
| 194 | MEASLES MORBILLIVIRUS | FTWDQKLWCRHFCVL | 1077 | P06830.1 |
| 195 | BORDETELLA PERTUSSIS | FVRDGQSVIGACASPYEGRYRDLYD ALRRLLY | 1078 | SRC280066 |
| 196 | BORDETELLA PERTUSSIS | FVRSGQPVIGACTSPYDGKYWSILYS RLRKMLY | 1079 | SRC280066 |
| 197 | MEASLES MORBILLIVIRUS | FYKDNPHPKGSRIVI | 1080 | P06830.1 |
| 198 | BORDETELLA PERTUSSIS | GAASSYFEYVDTYG | 1081 | ACI04548.1 |
| 199 | BORDETELLA PERTUSSIS | GAFDLKTTFCIMTTRNTGQPA | 1082 | AAA83981.1 |
| 200 | MEASLES VIRUS STRAIN EDMONSTON | GALIGILSLFVESPG | 1083 | P04851.1 |
| 201 | MEASLES VIRUS STRAIN EDMONSTON | GALIGILSLFVESPGQLIQR | 1084 | P04851.1 |
| 202 | RUBELLA VIRUS | GATPERPR | 1085 | CAJ88851.1 |
| 203 | BORDETELLA PERTUSSIS | GAYGRCPNGTRALTVAELRGNAEL | 1086 | P04979.1 |
| 204 | RUBELLA VIRUS | GCFAPWDLEATGACI | 1087 | BAA28178.1 |
| 205 | MEASLES MORBILLIVIRUS | GDINKVLEKLGYS | 1088 | BAB60865.1 |
| 206 | MEASLES MORBILLIVIRUS | GDINKVLEKLGYSGGDLLG | 1089 | AAL29688.1 |
| 207 | RUBELLA VIRUS | GDLRAVHHRPVPA | 1090 | CAA28880.1 |
| 208 | RUBELLA VIRUS | GDLVEYIMNYTGNQQ | 1091 | BAA28178.1 |
| 209 | MEASLES VIRUS STRAIN EDMONSTON | GDSSITTRSRLLDRL | 1092 | P04851.1 |
| 210 | MEASLES VIRUS STRAIN EDMONSTON | GDSSITTRSRLLDRLVRLIG | 1093 | P04851.1 |
| 211 | MEASLES MORBILLIVIRUS | GEDCHAPTYLPAEVD | 1094 | P06830.1 |
| 212 | MEASLES VIRUS STRAIN EDMONSTON | GELSTLESLMNLYQQ | 1095 | P04851.1 |
| 213 | MEASLES VIRUS STRAIN EDMONSTON | GELSTLESLMNLYQQMGKPA | 1096 | P04851.1 |

-continued

| NO. | DISEASE | EPITOPE AMINO ACID SEQUENCE | SEQ ID NO | ACCESS. NO. |
|---|---|---|---|---|
| 214 | MUMPS RUBULAVIRUS | GEQARYLALLEA | 1097 | P21186.1 |
| 215 | RUBELLA VIRUS | GEVWVT | 1098 | BAA19893.1 |
| 216 | RUBELLA VIRUS | GEVWVTPV | 1099 | CAJ88851.1 |
| 217 | RUBELLA VIRUS | GEVWVTPVIGSQAR | 1100 | BAA19893.1 |
| 218 | BORDETELLA PERTUSSIS | GEYGGVIKDGTPGGA | 1101 | AAA83981.1 |
| 219 | RUBELLA VIRUS | GFLSGVGPMRLRHGADT | 1102 | SRC265968 |
| 220 | MEASLES VIRUS STRAIN EDMONSTON-B | GFRASDVETAEGGEIHELLRLQ | 1103 | P03422.1 |
| 221 | BORDETELLA PERTUSSIS | GGAVPGGAVPGGAVPGGFGPGGFGP | 1104 | P14283.3 |
| 222 | BORDETELLA PERTUSSIS | GGAVPGGAVPGGFGPGGFGPGGFGP | 1105 | CAA09475.1 |
| 223 | BORDETELLA PERTUSSIS | GGAVPGGAVPGGFGPGGFGPGGFGPGGFGP | 1106 | CAA09474.1 |
| 224 | MEASLES MORBILLIVIRUS | GGHITHSGMVGMGVS | 1107 | P06830.1 |
| 225 | MEASLES MORBILLIVIRUS | GILESRGIKARITHVDTESY | 1108 | P26032.1 |
| 226 | BORDETELLA PERTUSSIS | GITGETTTTEYSNARYV | 1109 | CAD44970.1 |
| 227 | MEASLES VIRUS STRAIN EDMONSTON | GKEDRRVKQSRGE | 1110 | P04851.1 |
| 228 | BORDETELLA PERTUSSIS | GKVTNGS | 1111 | ACI16088.1 |
| 229 | RUBELLA VIRUS | GLGAWVPAAPCARIW | 1112 | BAA28178.1 |
| 230 | MEASLES VIRUS STRAIN EDMONSTON | GLIGIPALICCCRGR | 1113 | P69353.1 |
| 231 | RUBELLA VIRUS STRAIN THERIEN | GLLACCAKCLYYLRGAIAPR | 1114 | P07566.1 |
| 232 | MEASLES MORBILLIVIRUS | GLLAIAGIRLHRAAI | 1115 | P06830.1 |
| 233 | RUBELLA VIRUS | GLQPRADMAAPPTLPQ | 1116 | NP_740663.1 |
| 234 | MEASLES MORBILLIVIRUS | GMGVSCTVTREDGTNRR | 1117 | AAR89413.1 |
| 235 | MEASLES MORBILLIVIRUS | GMYGGTYLVEKP | 1118 | AAR89413.1 |
| 236 | BORDETELLA PERTUSSIS | GNAELQTYLRQITPGWSIYGLYDGTYLG | 1119 | P04979.1 |
| 237 | RUBELLA VIRUS | GNCHLTVNGEDVGAV | 1120 | BAA28178.1 |
| 238 | BORDETELLA PERTUSSIS | GNNDNVLDHLTGR | 1121 | P04977.1 |
| 239 | BORDETELLA PERTUSSIS | GNNDNVLDHLTGRSC | 1122 | P04977.1 |

| NO. | DISEASE | EPITOPE AMINO ACID SEQUENCE | SEQ ID NO | ACCESS. NO. |
|---|---|---|---|---|
| 240 | MEASLES VIRUS STRAIN EDMONSTON | GNRFILSQGNLIANC | 1123 | P69353.1 |
| 241 | RUBELLA VIRUS | GNRGRGQRRDWSRAPPPPEERQETRSQTPAPKPS | 1124 | P07566.1 |
| 242 | RUBELLA VIRUS | GPGEVWVT | 1125 | CAJ88851.1 |
| 243 | RUBELLA VIRUS STRAIN THERIEN | GPMRLRHGADTRCGRLI | 1126 | P07566.1 |
| 244 | BORDETELLA PERTUSSIS | GPNHTKV | 1127 | ACI16083.1 |
| 245 | MEASLES VIRUS STRAIN HALLE | GPRQAQVSF | 1128 | P10050.1 |
| 246 | MEASLES VIRUS STRAIN EDMONSTON | GPRQAQVSFLQGDQS | 1129 | P04851.1 |
| 247 | MEASLES VIRUS STRAIN EDMONSTON | GPRQAQVSFLQGDQSENELP | 1130 | P04851.1 |
| 248 | MEASLES MORBILLIVIRUS | GRGYNVSSIVTMTSQ | 1131 | P06830.1 |
| 249 | BORDETELLA PERTUSSIS | GRTPFII | 1132 | ACI16083.1 |
| 250 | RUBELLA VIRUS | GSPNCHGPDWASPVC | 1133 | BAA28178.1 |
| 251 | RUBELLA VIRUS | GSQARKCGLHIRAGP | 1134 | BAA28178.1 |
| 252 | BORDETELLA PERTUSSIS | GSSNSAFVSTSSSRR | 1135 | P04977.1 |
| 253 | MEASLES VIRUS STRAIN EDMONSTON | GSTKSCARTLVSGSF | 1136 | P69353.1 |
| 254 | RUBELLA VIRUS | GSYYKQYHPTACEVE | 1137 | BAA28178.1 |
| 255 | RUBELLA VIRUS | GTHTTAVSETRQTWA | 1138 | BAA28178.1 |
| 256 | MEASLES VIRUS STRAIN EDMONSTON | GTIINQDPDKILTYI | 1139 | P69353.1 |
| 257 | BORDETELLA PERTUSSIS | GTLVRMAPVIG | 1140 | ADA85124.1 |
| 258 | MEASLES VIRUS STRAIN EDMONSTON | GTPLDIDTASESS | 1141 | P04851.1 |
| 259 | BORDETELLA PERTUSSIS | GTYLGQAYGGIIKDAPPGAGFIYRETFC | 1142 | P04979.1 |
| 260 | BORDETELLA PERTUSSIS | GVATKGLGVHAKSSDWG | 1143 | P15318.2 |
| 261 | CORYNEBACTERIUM DIPHTHERIAE | GVLLPTIPGKLDVNKSKTHI | 1144 | AAV70486.1 |
| 262 | MEASLES MORBILLIVIRUS | GVLSVDLSLTVELKI | 1145 | P06830.1 |
| 263 | MEASLES MORBILLIVIRUS | GVPIELQVECFTWDQ | 1146 | P06830.1 |

-continued

| NO. | DISEASE | EPITOPE AMINO ACID SEQUENCE | SEQ ID NO | ACCESS. NO. |
|---|---|---|---|---|
| 264 | MEASLES VIRUS STRAIN EDMONSTON | GVSCTVTREDGTNRR | 1147 | P08362.1 |
| 265 | MEASLES VIRUS STRAIN EDMONSTON | GVSYNIGSQEWYTTV | 1148 | P69353.1 |
| 266 | MEASLES VIRUS STRAIN EDMONSTON | GYNVSSIVTMTSQGM | 1149 | P08362.1 |
| 267 | MEASLES MORBILLIVIRUS | HFCVLADSESGGHIT | 1150 | P06830.1 |
| 268 | MEASLES MORBILLIVIRUS | HGEDSITIPYQGSGK | 1151 | P06830.1 |
| 269 | RUBELLA VIRUS | HGPDWASP | 1152 | BAA19893.1 |
| 270 | RUBELLA VIRUS | HGPDWASPVCQRHSP | 1153 | BAA28178.1 |
| 271 | RUBELLA VIRUS | HGPDWASPVCQRHSPDCSRLVG | 1154 | CAJ88851.1 |
| 272 | RUBELLA VIRUS STRAIN M33 | HGPDWASPVCQRHSPDCSRLVGATPERPRLRLV | 1155 | CAJ88851.1 |
| 273 | MEASLES VIRUS STRAIN EDMONSTON | HITHSGMEGMGVSCT | 1156 | P08362.1 |
| 274 | MEASLES MORBILLIVIRUS | HKSLSTNLDVTNSIE | 1157 | P06830.1 |
| 275 | MEASLES VIRUS STRAIN EDMONSTON | HLMIDRPYV | 1158 | P08362.1 |
| 276 | MEASLES VIRUS STRAIN EDMONSTON | HLPTGTPLDIDTA | 1159 | P04851.1 |
| 277 | MEASLES VIRUS STRAIN EDMONSTON-B | HLPTGTPLDIDTATESSQDPQDSR | 1160 | Q77M43.1 |
| 278 | MEASLES MORBILLIVIRUS | HMTNYLEQPVSNDLS | 1161 | P06830.1 |
| 279 | MEASLES VIRUS STRAIN EDMONSTON | HQSLVIKLMPNITLL | 1162 | P69353.1 |
| 280 | MEASLES MORBILLIVIRUS | HRAAIYTAEIHKSLS | 1163 | P06830.1 |
| 281 | BORDETELLA PERTUSSIS | HRMQEAVEAERAGRGTGH | 1164 | P04977.1 |
| 282 | MEASLES VIRUS STRAIN EDMONSTON | HVDTESYFIVLSIAY | 1165 | P69353.1 |
| 283 | MEASLES VIRUS STRAIN EDMONSTON | HWGNLSKIGVVGIGS | 1166 | P69353.1 |
| 284 | RUBELLA VIRUS | HWWQLTLGATCALPL | 1167 | BAA28178.1 |
| 285 | RUBELLA VIRUS | HYRNASDVLPGHWLQGGWGCYNL | 1168 | NP_740663.1 |
| 286 | MEASLES VIRUS STRAIN EDMONSTON | IDLGPPISLERLDVG | 1169 | P69353.1 |

-continued

| NO. | DISEASE | EPITOPE AMINO ACID SEQUENCE | SEQ ID NO | ACCESS. NO. |
|---|---|---|---|---|
| 287 | MEASLES VIRUS STRAIN EDMONSTON | IEAIRQAGQEMILAV | 1170 | P69353.1 |
| 288 | RUBELLA VIRUS STRAIN M33 | IETRSARHP | 1171 | CAA28880.1 |
| 289 | MEASLES VIRUS STRAIN EDMONSTON | IGSQEWYTTVPKYVA | 1172 | P69353.1 |
| 290 | MEASLES VIRUS STRAIN EDMONSTON | IKGVIVHRLEGVSYN | 1173 | P69353.1 |
| 291 | MEASLES VIRUS STRAIN EDMONSTON | IKHIIVPIPGDSSI | 1174 | P04851.1 |
| 292 | MEASLES VIRUS STRAIN EDMONSTON | IKHIIVPIPGDSSITTRSR | 1175 | P04851.1 |
| 293 | BORDETELLA PERTUSSIS | IKLKDCP | 1176 | ACI16083.1 |
| 294 | MEASLES VIRUS STRAIN EDMONSTON | IKLMPNITLLNNCTR | 1177 | P69353.1 |
| 295 | MEASLES MORBILLIVIRUS | ILLERLDVGT | 1178 | AAF85664.1 |
| 296 | MEASLES MORBILLIVIRUS | ILPGQDLQYV | 1179 | P08362.1 |
| 297 | MEASLES VIRUS STRAIN EDMONSTON | ILTYIAADHCPVVEV | 1180 | P69353.1 |
| 298 | MEASLES MORBILLIVIRUS | INQDPDKILTY | 1181 | AAL29688.1 |
| 299 | MEASLES VIRUS STRAIN EDMONSTON | IPRFKVSPYLFNVPI | 1182 | P08362.1 |
| 300 | MEASLES VIRUS STRAIN EDMONSTON | IQALSYALGGDINKV | 1183 | P69353.1 |
| 301 | RUBELLA VIRUS | IRAGPYGHATVEMPE | 1184 | BAA28178.1 |
| 302 | BORDETELLA PERTUSSIS | IRMGTDK | 1185 | ACI16088.1 |
| 303 | MEASLES VIRUS STRAIN EDMONSTON | ISNFDESSCTFMPEG | 1186 | P69353.1 |
| 304 | MEASLES VIRUS STRAIN EDMONSTON | ITAGIALHQSMLNSQ | 1187 | P69353.1 |
| 305 | MEASLES VIRUS STRAIN EDMONSTON | ITDDPDVSIRLLEVV | 1188 | P04851.1 |
| 306 | MEASLES VIRUS STRAIN EDMONSTON | ITDDPDVSIRLLEVVQSDQS | 1189 | P04851.1 |
| 307 | BORDETELLA PERTUSSIS | ITTYV | 1190 | ACI16083.1 |

-continued

| NO. | DISEASE | EPITOPE AMINO ACID SEQUENCE | SEQ ID NO | ACCESS. NO. |
|---|---|---|---|---|
| 308 | MEASLES VIRUS STRAIN EDMONSTON | IVEAGLASFILTIKF | 1191 | P04851.1 |
| 309 | MEASLES VIRUS STRAIN EDMONSTON | IVEAGLASFILTIKFGIETM | 1192 | P04851.1 |
| 310 | MEASLES VIRUS STRAIN EDMONSTON | IVEAGLASFILTIKFGIETMYPALG | 1193 | P04851.1 |
| 311 | RUBELLA VIRUS | KALEAQSRALRAELAA | 1194 | P07566.1 |
| 312 | MEASLES VIRUS STRAIN EDMONSTON | KARITHVDTESYFIV | 1195 | P69353.1 |
| 313 | RUBELLA VIRUS | KCGLHIRAGPYGHAT | 1196 | BAA28178.1 |
| 314 | MEASLES VIRUS STRAIN EDMONSTON | KCYTTGTIINQDPDK | 1197 | P69353.1 |
| 315 | MEASLES VIRUS STRAIN EDMONSTON | KDNPHPKGSR | 1198 | P08362.1 |
| 316 | MEASLES VIRUS STRAIN EDMONSTON | KDNRIPSYGVLSVDL | 1199 | P08362.1 |
| 317 | MEASLES MORBILLIVIRUS | KFLNPDREYDFRDLT | 1200 | AAC35876.2 |
| 318 | RUBELLA VIRUS | KFVTAALLN | 1201 | BAA28178.1 |
| 319 | MEASLES VIRUS STRAIN EDMONSTON | KGNCSGPTTIR | 1202 | P08362.1 |
| 320 | MEASLES MORBILLIVIRUS | KIKFLNPDREYDFRD | 1203 | P06830.1 |
| 321 | RUBELLA VIRUS | KIVDGGCFAPWDLEA | 1204 | BAA28178.1 |
| 322 | MEASLES VIRUS STRAIN EDMONSTON | KLGLKLLRYYTEILS | 1205 | P69353.1 |
| 323 | MEASLES VIRUS STRAIN EDMONSTON | KLGVWKSPTDMQSWV | 1206 | P08362.1 |
| 324 | BORDETELLA PERTUSSIS | KLKECPQ | 1207 | ACI16088.1 |
| 325 | MEASLES MORBILLIVIRUS | KLLRYYTEI | 1208 | P26031.1 |
| 326 | MEASLES VIRUS STRAIN EDMONSTON | KLMPFSGDFV | 1209 | ABK40531.1 |
| 327 | MEASLES MORBILLIVIRUS | KLMPNITLL | 1210 | P26031.1 |
| 328 | MEASLES MORBILLIVIRUS | KLRMETCFQQACKGKIQALCENPEWA | 1211 | AAR89413.1 |
| 329 | MEASLES MORBILLIVIRUS | KLWCRHFCV | 1212 | P08362.1 |

-continued

| NO. | DISEASE | EPITOPE AMINO ACID SEQUENCE | SEQ ID NO | ACCESS. NO. |
|---|---|---|---|---|
| 330 | MEASLES VIRUS STRAIN EDMONSTON | KLWCRHFCVL | 1213 | P08362.1 |
| 331 | MEASLES MORBILLIVIRUS | KLWESPQEI | 1214 | BAB60863.1 |
| 332 | MEASLES VIRUS STRAIN EDMONSTON | KMSSAVGFV | 1215 | ABO69699.1 |
| 333 | MEASLES VIRUS STRAIN EDMONSTON-B | KMSSAVGFVPDTGPASR | 1216 | P03422.1 |
| 334 | BORDETELLA PERTUSSIS | KMVYATN | 1217 | ACI16083.1 |
| 335 | MEASLES VIRUS STRAIN EDMONSTON | KPDLTGTSKSYVRSL | 1218 | P69353.1 |
| 336 | MEASLES MORBILLIVIRUS | KPNLSSKRSELSQLS | 1219 | P08362.1 |
| 337 | MEASLES VIRUS STRAIN EDMONSTON | KPNLSSKRSELSQLSMYRVF | 1220 | P08362.1 |
| 338 | MEASLES VIRUS STRAIN EDMONSTON | KQSRGEARESYRETG | 1221 | P04851.1 |
| 339 | MEASLES VIRUS STRAIN EDMONSTON | KQSRGEARESYRETGPSRAS | 1222 | P04851.1 |
| 340 | MEASLES VIRUS STRAIN EDMONSTON | KRFAGVVLAGAALGV | 1223 | P69353.1 |
| 341 | MEASLES VIRUS STRAIN EDMONSTON | KRTPGNKPRIAEMIC | 1224 | P04851.1 |
| 342 | MEASLES VIRUS STRAIN EDMONSTON | KRTPGNKPRIAEMICDIDTY | 1225 | P04851.1 |
| 343 | MEASLES MORBILLIVIRUS | KSNHNNVYWLTIPPMKNLALGVINTL | 1226 | AAR89413.1 |
| 344 | MEASLES MORBILLIVIRUS | KVSPYLFNV | 1227 | P08362.1 |
| 345 | BORDETELLA PERTUSSIS | KVVQLPKISKNALKANG | 1228 | ACI16083.1 |
| 346 | BORDETELLA PERTUSSIS | KVVQLPKISKNALRNDG | 1229 | ACI16087.1 |
| 347 | BORDETELLA PERTUSSIS | LAHRRIPPENIR | 1230 | P04977.1 |
| 348 | BORDETELLA PERTUSSIS | LALALWAGFALS | 1231 | P11092.1 |
| 349 | RUBELLA VIRUS | LAPGGGNCHLTVNGE | 1232 | BAA28178.1 |
| 350 | MEASLES VIRUS STRAIN EDMONSTON | LAQIWVLLAKAVTAP | 1233 | P04851.1 |

-continued

| NO. | DISEASE | EPITOPE AMINO ACID SEQUENCE | SEQ ID NO | ACCESS. NO. |
|---|---|---|---|---|
| 351 | MEASLES VIRUS STRAIN EDMONSTON | LAQIWVLLAKAVTAPDTAAD | 1234 | P04851.1 |
| 352 | RUBELLA VIRUS | LASYFNPGGSYYKQYHPTACEVEPAF GHS | 1235 | BAA19893.1 |
| 353 | MEASLES MORBILLIVIRUS | LAVSKGNCSGPTTIR | 1236 | P06830.1 |
| 354 | MEASLES VIRUS STRAIN EDMONSTON | LCENPEWAPLKDNRI | 1237 | P08362.1 |
| 355 | MEASLES MORBILLIVIRUS | LDRLVRLIG | 1238 | ABI54110.1 |
| 356 | CORYNEBACTERIUM DIPHTHERIAE | LEEEGVTPL | 1239 | P33120.2 |
| 357 | BORDETELLA PERTUSSIS | LEHRMQEAVEAERAGRGTGHFI | 1240 | CAD44970.1 |
| 358 | MEASLES VIRUS STRAIN EDMONSTON | LEKLGYSGGDLLGIL | 1241 | P69353.1 |
| 359 | MEASLES VIRUS STRAIN EDMONSTON | LEQPVSNDLS | 1242 | P08362.1 |
| 360 | MEASLES VIRUS STRAIN EDMONSTON | LERKWLDVVRNIIAE | 1243 | P04851.1 |
| 361 | MEASLES VIRUS STRAIN EDMONSTON | LERKWLDVVRNIIAEDLSLR | 1244 | P04851.1 |
| 362 | MEASLES VIRUS STRAIN EDMONSTON | LFGPSLRDPISAEIS | 1245 | P69353.1 |
| 363 | MEASLES MORBILLIVIRUS | LGELKLAALCHGEDS | 1246 | P06830.1 |
| 364 | MEASLES VIRUS STRAIN EDMONSTON | LGGKEDRRVKQSR | 1247 | P04851.1 |
| 365 | RUBELLA VIRUS | LGHDGHHGGTLRVGQHHRNASDVL | 1248 | ABD64214.1 |
| 366 | RUBELLA VIRUS STRAIN THERIEN | LGSPNCHGPDWASPVCQRHS | 1249 | P07566.1 |
| 367 | RUBELLA VIRUS STRAIN THERIEN | LGSPNCHGPDWASPVCQRHSPDCSRLV | 1250 | P07566.1 |
| 368 | RUBELLA VIRUS | LHDPDTEAPTEACVTSWL | 1251 | ABD64214.1 |
| 369 | MEASLES VIRUS STRAIN EDMONSTON | LIANCASILCKCYTT | 1252 | P69353.1 |
| 370 | MEASLES MORBILLIVIRUS | LIGLLAIAGIRLHRAAIYTAEIHK | 1253 | AAR89413.1 |
| 371 | MEASLES VIRUS STRAIN EDMONSTON | LIPSMNQLSCDLIGQ | 1254 | P69353.1 |
| 372 | MEASLES VIRUS STRAIN EDMONSTON | LKIKIASGFGPLITH | 1255 | P08362.1 |

-continued

| NO. | DISEASE | EPITOPE AMINO ACID SEQUENCE | SEQ ID NO | ACCESS. NO. |
|---|---|---|---|---|
| 373 | MEASLES MORBILLIVIRUS | LKIKIASGFGPLITHGSGMDLYK | 1256 | AAR89413.1 |
| 374 | BORDETELLA PERTUSSIS | LKLYFEP | 1257 | ACI16088.1 |
| 375 | MEASLES VIRUS STRAIN EDMONSTON | LLAVLFVMFL | 1258 | P08362.1 |
| 376 | MEASLES VIRUS STRAIN EDMONSTON | LLDRLVRLIGNPDVS | 1259 | P04851.1 |
| 377 | MEASLES VIRUS STRAIN EDMONSTON | LLDRLVRLIGNPDVSGPKLT | 1260 | P04851.1 |
| 378 | MEASLES VIRUS STRAIN EDMONSTON | LLESSDQILRSMKGL | 1261 | P69353.1 |
| 379 | MEASLES MORBILLIVIRUS | LLETRTTNQFLAVSK | 1262 | P06830.1 |
| 380 | MEASLES VIRUS STRAIN EDMONSTON | LLEVVQSDQSQSGLT | 1263 | P04851.1 |
| 381 | MEASLES VIRUS STRAIN EDMONSTON | LLEVVQSDQSQSGLTFASR | 1264 | P04851.1 |
| 382 | MEASLES VIRUS STRAIN EDMONSTON | LLEVVQSDQSQSGLTFASRG | 1265 | P04851.1 |
| 383 | MEASLES MORBILLIVIRUS | LLGILESRGIKARIT | 1266 | AAL29688.1 |
| 384 | RUBELLA VIRUS | LLRTAPGP | 1267 | CAJ88851.1 |
| 385 | MEASLES VIRUS STRAIN EDMONSTON | LLRYYTEILSLFGPS | 1268 | P69353.1 |
| 386 | RUBELLA VIRUS STRAIN THERIEN | LLVPWVLIFMVCRRACRRRG | 1269 | P07566.1 |
| 387 | MEASLES VIRUS STRAIN EDMONSTON | LLWRSRCKIV | 1270 | ABK40528.1 |
| 388 | MEASLES MORBILLIVIRUS | LLWSYAMGV | 1271 | P04851.1 |
| 389 | MEASLES VIRUS STRAIN EDMONSTON | LLWSYAMGVGVELEN | 1272 | P04851.1 |
| 390 | MEASLES VIRUS STRAIN EDMONSTON | LLWSYAMGVGVELENSMGGL | 1273 | P04851.1 |
| 391 | MEASLES MORBILLIVIRUS | LMIDRPYVL | 1274 | P08362.1 |
| 392 | MEASLES VIRUS STRAIN EDMONSTON | LNAMTQNIRPVQSVA | 1275 | P69353.1 |
| 393 | RUBELLA VIRUS | LNTPPPYQVSCGGES | 1276 | BAA28178.1 |
| 394 | MEASLES VIRUS STRAIN EDMONSTON | LRDPISAEISIQALS | 1277 | P69353.1 |

-continued

| NO. | DISEASE | EPITOPE AMINO ACID SEQUENCE | SEQ ID NO | ACCESS. NO. |
|---|---|---|---|---|
| 395 | BORDETELLA PERTUSSIS | LRGSGDLQEYLRHVTR | 1278 | AAA83981.1 |
| 396 | RUBELLA VIRUS | LRLVDADD | 1279 | CAJ88851.1 |
| 397 | RUBELLA VIRUS | LRLVDADDPLLR | 1280 | BAA19893.1 |
| 398 | RUBELLA VIRUS | LRLVDADDPLLRTAPGPGEVWVTPVIGSQAR | 1281 | BAA19893.1 |
| 399 | BORDETELLA PERTUSSIS | LRRLLYMIYMSGLAVRVHVSKEEQYYDY | 1282 | P04979.1 |
| 400 | RUBELLA VIRUS | LRTAPGPG | 1283 | CAJ88851.1 |
| 401 | RUBELLA VIRUS | LRVGQHYRNASDVLPGHWLQ | 1284 | NP_740663.1 |
| 402 | BORDETELLA PERTUSSIS | LRYLA | 1285 | ACI16088.1 |
| 403 | MEASLES VIRUS STRAIN EDMONSTON | LSCKPWQESRKNK | 1286 | P04851.1 |
| 404 | MEASLES MORBILLIVIRUS | LSEIKGVIVHRLEGV | 1287 | AAL29688.1 |
| 405 | MEASLES VIRUS STRAIN EDMONSTON | LSIAYPTLSEIKGVI | 1288 | P69353.1 |
| 406 | MEASLES VIRUS STRAIN EDMONSTON | LSLLDLYLGRGYNVS | 1289 | P08362.1 |
| 407 | MEASLES VIRUS STRAIN EDMONSTON | LSQGNLIANCASILC | 1290 | P69353.1 |
| 408 | MEASLES MORBILLIVIRUS | LSSHRGVIADNQAKW | 1291 | P06830.1 |
| 409 | MEASLES VIRUS STRAIN EDMONSTON | LSVDLSLTVELKIKI | 1292 | P08362.1 |
| 410 | BORDETELLA PERTUSSIS | LTGISICNPGSSLC | 1293 | AAA83981.1 |
| 411 | MEASLES VIRUS STRAIN EDMONSTON | LTIKFGIETMYPALG | 1294 | P04851.1 |
| 412 | MEASLES VIRUS STRAIN EDMONSTON | LTIKFGIETMYPALGLHEFA | 1295 | P04851.1 |
| 413 | MEASLES VIRUS STRAIN EDMONSTON | LTLQTPTGQIHWGNL | 1296 | P69353.1 |
| 414 | RUBELLA VIRUS | LVDADDPL | 1297 | CAJ88851.1 |
| 415 | RUBELLA VIRUS | LVDADDPLLR | 1298 | BAA19893.1 |
| 416 | MEASLES VIRUS STRAIN EDMONSTON | LVEKPNLSSKRSELS | 1299 | P08362.1 |
| 417 | RUBELLA VIRUS | LVGATPE | 1300 | BAA19893.1 |
| 418 | RUBELLA VIRUS | LVGATPER | 1301 | CAJ88851.1 |
| 419 | MEASLES MORBILLIVIRUS | LVKLGVWKSPTGMQS | 1302 | P06830.1 |

| NO. | DISEASE | EPITOPE AMINO ACID SEQUENCE | SEQ ID NO | ACCESS. NO. |
|---|---|---|---|---|
| 420 | MEASLES VIRUS STRAIN EDMONSTON-B | LVSGSFGNRFILSQGNLI | 1303 | P26031.1 |
| 421 | MEASLES VIRUS STRAIN EDMONSTON | LYKSNHNNVYWLTIP | 1304 | P08362.1 |
| 422 | MEASLES VIRUS STRAIN EDMONSTON | LYPMSPLLQECLRGSTKSCARTLVS | 1305 | P69353.1 |
| 423 | RUBELLA VIRUS | MASTTPITMEDLQKALEA | 1306 | P07566.1 |
| 424 | RUBELLA VIRUS | MASTTPITMEDLQKALEAQSR | 1307 | ABD64200.1 |
| 425 | RUBELLA VIRUS STRAIN THERIEN | MASTTPITMEDLQKALEAQSRALRAELAA | 1308 | P07566.1 |
| 426 | RUBELLA VIRUS | MASTTPITMEDLQKALEAQSRALRAGLAA | 1309 | ABD64200.1 |
| 427 | RUBELLA VIRUS VACCINE STRAIN RA27/3 | MASTTPITMEDLQKALETQSRVLRAGLTA | 1310 | CAA33016.1 |
| 428 | MEASLES VIRUS STRAIN EDMONSTON | MATLLRSLALFKRNK | 1311 | P04851.1 |
| 429 | MEASLES VIRUS STRAIN EDMONSTON | MATLLRSLALFKRNKDKPPI | 1312 | P04851.1 |
| 430 | MEASLES MORBILLIVIRUS | MDLYKSNHNNVYWLT | 1313 | P06830.1 |
| 431 | RUBELLA VIRUS | MEDLQKALEAQSRA | 1314 | P07566.1 |
| 432 | RUBELLA VIRUS | MEDLQKALEAQSRALRAELAA | 1315 | P07566.1 |
| 433 | MEASLES VIRUS STRAIN EDMONSTON | MGLKVNVSAIFMAVL | 1316 | P69353.1 |
| 434 | MEASLES MORBILLIVIRUS | MIDRPYVLLAVLFVM | 1317 | P06830.1 |
| 435 | MEASLES VIRUS STRAIN EDMONSTON | MILAVQGVQDYINNE | 1318 | P69353.1 |
| 436 | MEASLES VIRUS STRAIN EDMONSTON | MLNSQAIDNLRASLE | 1319 | P69353.1 |
| 437 | MEASLES VIRUS STRAIN EDMONSTON | MNALVNSTLLETRTT | 1320 | P08362.1 |
| 438 | RUBELLA VIRUS | MNYTGNQQSRWGLGSPNCHGPDWASPVCQRHS | 1321 | BAA19893.1 |
| 439 | MEASLES VIRUS STRAIN EDMONSTON | MQSWVPLSTDDPVID | 1322 | P08362.1 |
| 440 | MEASLES MORBILLIVIRUS | MSLSLLDLYLGRGYN | 1323 | P06830.1 |
| 441 | MEASLES VIRUS STRAIN EDMONSTON | MSPLLQECLRGSTKS | 1324 | P69353.1 |

| NO. | DISEASE | EPITOPE AMINO ACID SEQUENCE | SEQ ID NO | ACCESS. NO. |
|---|---|---|---|---|
| 442 | MEASLES MORBILLIVIRUS | MSPQRDRINAFYKDN | 1325 | P06830.1 |
| 443 | MEASLES MORBILLIVIRUS | MYRVFEVSVIRNPGL | 1326 | P06830.1 |
| 444 | MEASLES VIRUS STRAIN EDMONSTON | NALYPMSPLLQECLR | 1327 | P69353.1 |
| 445 | RUBELLA VIRUS STRAIN THERIEN | NCHGPDWASPVCQRHSPDCSRLVGAT | 1328 | P07566.1 |
| 446 | MEASLES VIRUS STRAIN EDMONSTON | NFGRSYFDPAYFRLG | 1329 | P04851.1 |
| 447 | MEASLES VIRUS STRAIN EDMONSTON | NFGRSYFDPAYFRLGQEMVR | 1330 | P04851.1 |
| 448 | RUBELLA VIRUS | NGTQRACTFWAVNAY | 1331 | BAA28178.1 |
| 449 | MEASLES VIRUS STRAIN EDMONSTON | NGVTIQVGSRRYPDA | 1332 | P69353.1 |
| 450 | MEASLES VIRUS STRAIN EDMONSTON | NIIAEDLSLRRFMVA | 1333 | P04851.1 |
| 451 | MEASLES VIRUS STRAIN EDMONSTON | NIIAEDLSLRRFMVALILDI | 1334 | P04851.1 |
| 452 | MEASLES VIRUS STRAIN EDMONSTON | NITLLNNCTRVEIAE | 1335 | P69353.1 |
| 453 | MEASLES MORBILLIVIRUS | NLALGVINTLEWIPR | 1336 | P06830.1 |
| 454 | CORYNEBACTERUMI DIPHTHERIAE | NLFQVVHWSYNRPAYSPG | 1337 | SRC280292 |
| 455 | MEASLES VIRUS STRAIN EDMONSTON | NLVILPGQDLQYVLA | 1338 | P08362.1 |
| 456 | MEASLES VIRUS STRAIN EDMONSTON | NLYQQMGKPAPYMVN | 1339 | P04851.1 |
| 457 | MEASLES VIRUS STRAIN EDMONSTON | NLYQQMGKPAPYMVNLENSI | 1340 | P04851.1 |
| 458 | MEASLES VIRUS STRAIN EDMONSTON | NNCTRVEIAEYRRLL | 1341 | P69353.1 |
| 459 | MEASLES VIRUS STRAIN EDMONSTON | NPDREYDFRD | 1342 | P08362.1 |
| 460 | MEASLES VIRUS STRAIN HALLE | NPDVSGPKL | 1343 | P10050.1 |
| 461 | MEASLES VIRUS STRAIN EDMONSTON | NPDVSGPKLTGALIG | 1344 | P04851.1 |
| 462 | MEASLES VIRUS STRAIN EDMONSTON | NPDVSGPKLTGALIGILSLF | 1345 | P04851.1 |

| NO. | DISEASE | EPITOPE AMINO ACID SEQUENCE | SEQ ID NO | ACCESS. NO. |
|---|---|---|---|---|
| 463 | MEASLES MORBILLIVIRUS | NPPERIKLDYDQYCA | 1346 | P06830.1 |
| 464 | MEASLES MORBILLIVIRUS | NQAKWAVPTTRTDDK | 1347 | P06830.1 |
| 465 | MEASLES MORBILLIVIRUS | NQDPDKILTYIAADH | 1348 | AAF02706.1 |
| 466 | MEASLES VIRUS STRAIN EDMONSTON | NQLSCDLIGQKLGLK | 1349 | P69353.1 |
| 467 | RUBELLA VIRUS | NQQSRWGLGSPNCHGPDWASPVCQRHS | 1350 | ABD64214.1 |
| 468 | MUMPS RUBULAVIRUS | NSTLGVKSAREF | 1351 | ABP48111.1 |
| 469 | RUBELLA VIRUS | NTPHGQLEVQVPPDP | 1352 | BAA28178.1 |
| 470 | MEASLES VIRUS STRAIN EDMONSTON | NVSAIFMAVLLTLQT | 1353 | P69353.1 |
| 471 | MEASLES MORBILLIVIRUS | PAEVDGDVKLSSNLV | 1354 | P06830.1 |
| 472 | RUBELLA VIRUS | PAFGHSDAACWGFPT | 1355 | BAA28178.1 |
| 473 | MEASLES VIRUS STRAIN EDMONSTON | PALICCCRGRCNKKG | 1356 | P69353.1 |
| 474 | MEASLES MORBILLIVIRUS | PDKILTYIAADHC | 1357 | AAF02706.1 |
| 475 | MEASLES VIRUS STRAIN EDMONSTON | PERIKLDYDQYCADV | 1358 | P08362.1 |
| 476 | RUBELLA VIRUS | PERPRLRL | 1359 | CAJ88851.1 |
| 477 | RUBELLA VIRUS | PGCATQAPVPVRLAG | 1360 | BAA28178.1 |
| 478 | RUBELLA VIRUS VACCINE STRAIN RA27/3 | PGCATQAPVPVRLAGVRFESKIVDGGCFA | 1361 | CAJ88851.1 |
| 479 | RUBELLA VIRUS | PGEVWVTP | 1362 | CAJ88851.1 |
| 480 | RUBELLA VIRUS | PGEVWVTPVIGSQAR | 1363 | BAA28178.1 |
| 481 | CORYNEBACTERIUM DIPHTHERIAE | PGKLDVNKSKTHISVN | 1364 | CAE11230.1 |
| 482 | MEASLES VIRUS STRAIN EDMONSTON | PGLGAPVFHMTNYLE | 1365 | P08362.1 |
| 483 | RUBELLA VIRUS | PGPGEVWV | 1366 | CAJ88851.1 |
| 484 | RUBELLA VIRUS | PHKTVRVKFHTETRT | 1367 | BAA28178.1 |
| 485 | MEASLES MORBILLIVIRUS | PIELQVECFTWDQKL | 1368 | AAR89413.1 |
| 486 | MEASLES VIRUS STRAIN EDMONSTON-B | PISLERLDVG | 1369 | P26031.1 |
| 487 | MEASLES VIRUS STRAIN EDMONSTON | PISLERLDVGTNLGN | 1370 | P69353.1 |

| NO. | DISEASE | EPITOPE AMINO ACID SEQUENCE | SEQ ID NO | ACCESS. NO. |
| --- | --- | --- | --- | --- |
| 488 | BORDETELLA PERTUSSIS | PKALFTQQGGAYGRC | 1371 | P04979.1 |
| 489 | MEASLES VIRUS STRAIN EDMONSTON | PKYVATQGYLISNFD | 1372 | P69353.1 |
| 490 | MEASLES VIRUS STRAIN EDMONSTON | PLDIDTASESSQD | 1373 | P04851.1 |
|

-continued

| NO. | DISEASE | EPITOPE AMINO ACID SEQUENCE | SEQ ID NO | ACCESS. NO. |
|---|---|---|---|---|
| 512 | RUBELLA VIRUS | PVALPRTLAPPRNVR | 1395 | BAA28178.1 |
| 513 | CORYNEBACTERIUM DIPHTHERIAE | PVFAGANYAAWAVNVAQVI | 1396 | AAV70486.1 |
| 514 | RUBELLA VIRUS | PVIGSQAR | 1397 | CAJ88851.1 |
| 515 | MEASLES MORBILLIVIRUS | PVVEVNGVTIQVGSR | 1398 | AAL29688.1 |
| 516 | RUBELLA VIRUS STRAIN THERIEN | PWELVVLTARPEDGWTCRGV | 1399 | P07566.1 |
| 517 | MEASLES VIRUS STRAIN EDMONSTON | PWQESRKNKAQTR | 1400 | P04851.1 |
| 518 | MEASLES VIRUS STRAIN EDMONSTON | PYMVNLENSIQNKFS | 1401 | P04851.1 |
| 519 | MEASLES VIRUS STRAIN EDMONSTON | PYMVNLENSIQNKFSAGSYP | 1402 | P04851.1 |
| 520 | MEASLES VIRUS STRAIN EDMONSTON | PYQGSGKGVS | 1403 | P08362.1 |
| 521 | RUBELLA VIRUS | PYQVSCGGESDRASA | 1404 | BAA28178.1 |
| 522 | MEASLES MORBILLIVIRUS | QACKGKIQALCEN | 1405 | P08362.1 |
| 523 | MEASLES VIRUS STRAIN EDMONSTON | QAGQEMILAVQGVQD | 1406 | P69353.1 |
| 524 | MEASLES MORBILLIVIRUS | QALCENPECVPLKDN | 1407 | P06830.1 |
| 525 | BORDETELLA PERTUSSIS | QALGALK | 1408 | ACI16088.1 |
| 526 | RUBELLA VIRUS | QAPVPVRLAGVRFES | 1409 | BAA28178.1 |
| 527 | RUBELLA VIRUS | QCGTPALVEGLAPGG | 1410 | BAA28178.1 |
| 528 | MEASLES VIRUS STRAIN EDMONSTON | QDPDKILTYIAADHC | 1411 | P69353.1 |
| 529 | MEASLES VIRUS STRAIN EDMONSTON | QECLRGSTKSCARTL | 1412 | P69353.1 |
| 530 | BORDETELLA PERTUSSIS | QEQITQHGSPYGRC | 1413 | AAA83981.1 |
| 531 | MEASLES VIRUS STRAIN EDMONSTON | QESRKNKAQTRTP | 1414 | P04851.1 |
| 532 | MEASLES VIRUS STRAIN EDMONSTON | QGDQSENELPRLGGK | 1415 | P04851.1 |
| 533 | MEASLES VIRUS STRAIN EDMONSTON | QGDQSENELPRLGGKEDRRV | 1416 | P04851.1 |
| 534 | CORYNEBACTERIUM DIPHTHERIAE | QGESGHDIKITAENTPLPIA | 1417 | AAV70486.1 |
| 535 | MEASLES MORBILLIVIRUS | QGSGKGVSFQLVKLG | 1418 | P06830.1 |

| NO. | DISEASE | EPITOPE AMINO ACID SEQUENCE | SEQ ID NO | ACCESS. NO. |
|---|---|---|---|---|
| 536 | MEASLES VIRUS STRAIN EDMONSTON | QGVQDYINNELIPSM | 1419 | P69353.1 |
| 537 | RUBELLA VIRUS | QLEV

-continued

| NO. | DISEASE | EPITOPE AMINO ACID SEQUENCE | SEQ ID NO | ACCESS. NO. |
|---|---|---|---|---|
| 557 | MEASLES VIRUS STRAIN EDMONSTON | QSRGEARESYRETGPSRA | 1440 | P04851.1 |
| 558 | RUBELLA VIRUS STRAIN THERIEN | QTGRGGSAPRPELGPPTN | 1441 | P07566.1 |
| 559 | RUBELLA VIRUS STRAIN THERIEN | QTPAPKPSRAPPQQPQPPRMQTGRG | 1442 | P07566.1 |
| 560 | MEASLES VIRUS STRAIN EDMONSTON | QVGSRRYPDAVYLHR | 1443 | P69353.1 |
| 561 | MEASLES VIRUS STRAIN EDMONSTON | QVSFLQGDQSENE | 1444 | P04851.1 |
| 562 | RUBELLA VIRUS | QYHPTACEVEPAFGH | 1445 | BAA28178.1 |
| 563 | MEASLES VIRUS STRAIN EDMONSTON | QYVLATYDTSRVEHA | 1446 | P08362.1 |
| 564 | BORDETELLA PERTUSSIS | RANPNPYTSRRSV | 1447 | ACI04548.1 |
| 565 | MEASLES VIRUS STRAIN EDMONSTON | RASDARAAHLPTG | 1448 | P04851.1 |
| 566 | MEASLES VIRUS STRAIN EDMONSTON | RASLETTNQAIEAIR | 1449 | P69353.1 |
| 567 | RUBELLA VIRUS STRAIN THERIEN | RCGRLICGLSTTAQYPPTRF | 1450 | P07566.1 |
| 568 | BORDETELLA PERTUSSIS | RDGQSVIGACASPYEGRYR | 1451 | P04979.1 |
| 569 | MEASLES VIRUS STRAIN EDMONSTON | RESYRETGPSRAS | 1452 | P04851.1 |
| 570 | MEASLES VIRUS STRAIN EDMONSTON | RETGPSRASDARA | 1453 | P04851.1 |
| 571 | MUMPS RUBULAVIRUS | RFAKYQQQGRLEAR | 1454 | P21186.1 |
| 572 | RUBELLA VIRUS STRAIN THERIEN | RFGAPQAFLAGLLLATVAVGTARA | 1455 | P07566.1 |
| 573 | MEASLES VIRUS STRAIN EDMONSTON | RFMVALILDIKRTPG | 1456 | P04851.1 |
| 574 | MEASLES VIRUS STRAIN EDMONSTON | RFMVALILDIKRTPGNKPRI | 1457 | P04851.1 |
| 575 | MEASLES VIRUS STRAIN EDMONSTON | RGEARESYRETGP | 1458 | P04851.1 |
| 576 | RUBELLA VIRUS | RGTTPPAYG | 1459 | CAA28880.1 |
| 577 | RUBELLA VIRUS STRAIN M33 | RIETRSARH | 1460 | ABD64214.1 |
| 578 | BORDETELLA PERTUSSIS | RILAGALATYQ | 1461 | P04977.1 |

-continued

| NO. | DISEASE | EPITOPE AMINO ACID SEQUENCE | SEQ ID NO | ACCESS. NO. |
|---|---|---|---|---|
| 579 | BORDETELLA PERTUSSIS | RIPPENIRRVT | 1462 | ACI04548.1 |
| 580 | BORDETELLA PERTUSSIS | RISNLND | 1463 | ACI16083.1 |
| 581 | BORDETELLA PERTUSSIS | RLANLNG | 1464 | ACI16088.1 |
| 582 | MEASLES VIRUS STRAIN EDMONSTON | RLDVGTNLGNAIAKL | 1465 | P69353.1 |
| 583 | MEASLES VIRUS STRAIN EDMONSTON | RLERKWLDV | 1466 | P04851.1 |
| 584 | MEASLES VIRUS STRAIN EDMONSTON | RLGGKEDRRVKQSRG | 1467 | P04851.1 |
| 585 | MEASLES VIRUS STRAIN EDMONSTON | RLGGKEDRRVKQSRGEARES | 1468 | P04851.1 |
| 586 | MEASLES VIRUS STRAIN EDMONSTON | RLLDRLVRL | 1469 | ABI54110.1 |
| 587 | RUBELLA VIRUS | RLRLVDAD | 1470 | CAJ88851.1 |
| 588 | RUBELLA VIRUS | RLRLVDADDPLLR | 1471 | BAA19893.1 |
| 589 | RUBELLA VIRUS | RLRLVDADDPLLRTAPGPGEVWVTPVIGSQA | 1472 | BAA19893.1 |
| 590 | RUBELLA VIRUS | RLRLVQDADDPLLRIAPGPGEVWVTPVIGSQA | 1473 | SRC265968 |
| 591 | MEASLES VIRUS STRAIN EDMONSTON | RLSDNGYYTV | 1474 | ABK40528.1 |
| 592 | RUBELLA VIRUS | RLVDADDP | 1475 | CAJ88851.1 |
| 593 | RUBELLA VIRUS | RLVDADDPLLRTAPG | 1476 | BAA28178.1 |
| 594 | RUBELLA VIRUS | RLVGATPE | 1477 | CAJ88851.1 |
| 595 | RUBELLA VIRUS | RMQTGRGGSAPRPELGPPTNPFQAAVA | 1478 | ABD64216.1 |
| 596 | MEASLES MORBILLIVIRUS | RMSKGVFKV | 1479 | ABY21184.1 |
| 597 | MEASLES MORBILLIVIRUS | RNPGLGAPVFHMTNY | 1480 | P06830.1 |
| 598 | RUBELLA VIRUS | RPRLRLVD | 1481 | CAJ88851.1 |
| 599 | BORDETELLA PERTUSSIS | RQAESSEAMAAWSERAGEA | 1482 | P04977.1 |
| 600 | RUBELLA VIRUS | RQTWAEWAAAHWWQL | 1483 | BAA28178.1 |
| 601 | MEASLES VIRUS STRAIN EDMONSTON | RRVKQSRGEARES | 1484 | P04851.1 |
| 602 | MEASLES MORBILLIVIRUS | RRYPDAVYL | 1485 | ACA09725.1 |
| 603 | MEASLES VIRUS STRAIN EDMONSTON | RRYPDAVYLHRIDLG | 1486 | P69353.1 |

-continued

| NO. | DISEASE | EPITOPE AMINO ACID SEQUENCE | SEQ ID NO | ACCESS. NO. |
|---|---|---|---|---|
| 604 | MEASLES VIRUS STRAIN EDMONSTON | RSAGKVSSTLASELG | 1487 | P04851.1 |
| 605 | MEASLES VIRUS STRAIN EDMONSTON | RSAGKVSSTLASELGITAED | 1488 | P04851.1 |
| 606 | MEASLES VIRUS STRAIN EDMONSTON | RSELSQLS | 1489 | P08362.1 |
| 607 | MEASLES VIRUS STRAIN EDMONSTON | RSELSQLSMYRVFEV | 1490 | P08362.1 |
| 608 | RUBELLA VIRUS | RSQTPAPKPSRAPPQQPQPPRMQT | 1491 | ABD64214.1 |
| 609 | RUBELLA VIRUS | RTAPGPGE | 1492 | CAJ88851.1 |
| 610 | RUBELLA VIRUS | RTAPGPGEVWVTPVI | 1493 | BAA28178.1 |
| 611 | MEASLES MORBILLIVIRUS | RTDDKLRMETCFQQA | 1494 | P06830.1 |
| 612 | RUBELLA VIRUS | RTLAPPRNVRVTGCY | 1495 | BAA28178.1 |
| 613 | MEASLES VIRUS STRAIN EDMONSTON | RTVLEPIRDALNAMT | 1496 | P69353.1 |
| 614 | MEASLES VIRUS STRAIN EDMONSTON | RVEHAVVYYVYSPSR | 1497 | P08362.1 |
| 615 | MEASLES VIRUS STRAIN EDMONSTON | RVFEVGVIRNPGLGA | 1498 | P08362.1 |
| 616 | BORDETELLA PERTUSSIS | RVHVSKEEQYYDYEDATFE | 1499 | P04978.2 |
| 617 | RUBELLA VIRUS | RVIDPAAQ | 1500 | BAA28178.1 |
| 618 | RUBELLA VIRUS | RVKFHTETRTVWQLS | 1501 | BAA28178.1 |
| 619 | BORDETELLA PERTUSSIS | RVYHNGITGET | 1502 | ACI04548.1 |
| 620 | BORDETELLA PERTUSSIS | RYDSRPPEDVF | 1503 | ACI04548.1 |
| 621 | MEASLES VIRUS STRAIN EDMONSTON | RYPDAVYLHRIDLGP | 1504 | P69353.1 |
| 622 | MEASLES VIRUS STRAIN EDMONSTON | SAEISIQALSYALGG | 1505 | P69353.1 |
| 623 | MEASLES VIRUS STRAIN EDMONSTON | SAEPLLSCKPWQESR | 1506 | P04851.1 |
| 624 | MEASLES VIRUS STRAIN EDMONSTON | SAEPLLSCKPWQESRKNKAQ | 1507 | P04851.1 |
| 625 | MEASLES MORBILLIVIRUS | SAGKVSSTLASELG | 1508 | P04851.1 |
| 626 | MEASLES VIRUS STRAIN EDMONSTON | SAGKVSSTLASELGITAEDARLVS | 1509 | P04851.1 |

| NO. | DISEASE | EPITOPE AMINO ACID SEQUENCE | SEQ ID NO | ACCESS. NO. |
|---|---|---|---|---|
| 627 | MEASLES VIRUS STRAIN EDMONSTON | SCTVTREDGT | 1510 | P08362.1 |
| 628 | RUBELLA VIRUS | SDAACWGFPT

-continued

| NO. | DISEASE | EPITOPE AMINO ACID SEQUENCE | SEQ ID NO | ACCESS. NO. |
|---|---|---|---|---|
| 647 | MEASLES MORBILLIVIRUS | SMYRVFEVGV | 1530 | P08362.1 |
| 648 | MEASLES MORBILLIVIRUS | SNDLSNCMVALGELK | 1531 | P06830.1 |
| 649 | MEASLES VIRUS STRAIN HALLE | SPGQLIQR | 1532 | P10050.1 |
| 650 | MEASLES VIRUS STRAIN EDMONSTON | SQDPQDSRRSAEP | 1533 | P04851.1 |
| 651 | MEASLES MORBILLIVIRUS | SRIVINREHLMIDRP | 1534 | P06830.1 |
| 652 | MEASLES VIRUS STRAIN EDMONSTON | SRKNKAQTRTPLQ | 1535 | P04851.1 |
| 653 | RUBELLA VIRUS | SRLVGATP | 1536 | CAJ88851.1 |
| 654 | RUBELLA VIRUS | SRLVGATPERPRLRLVDADDPLLR | 1537 | CAJ88851.1 |
| 655 | MEASLES VIRUS STRAIN EDMONSTON | SRPGLKPDLTGTSKS | 1538 | P69353.1 |
| 656 | BORDETELLA PERTUSSIS | SRRSVASIVGTLVRM | 1539 | CAD44970.1 |
| 657 | RUBELLA VIRUS | SRWGLGSPNCHGPDW | 1540 | BAA28178.1 |
| 658 | BORDETELLA PERTUSSIS | SSATK | 1541 | ACI16088.1 |
| 659 | RUBELLA VIRUS | SSGGYAQLASYFNPG | 1542 | BAA28178.1 |
| 660 | BORDETELLA PERTUSSIS | SSLGNGV | 1543 | ACI16083.1 |
| 661 | MEASLES MORBILLIVIRUS | SSNLVILPGQDLQYV | 1544 | P06830.1 |
| 662 | MEASLES VIRUS STRAIN EDMONSTON | SSQDPQDSRRSAEPL | 1545 | P04851.1 |
| 663 | MEASLES VIRUS STRAIN EDMONSTON | SSQDPQDSRRSAEPLLSCKP | 1546 | P04851.1 |
| 664 | MEASLES VIRUS STRAIN EDMONSTON | SSRRHKRFAGVVLAG | 1547 | P69353.1 |
| 665 | MEASLES VIRUS STRAIN EDMONSTON | SSTSIVYILIAVCLG | 1548 | P69353.1 |
| 666 | BORDETELLA PERTUSSIS | STPGIVI | 1549 | AAA83981.1 |
| 667 | BORDETELLA PERTUSSIS | STPGIVIPPQEQITQHGSPYGRC | 1550 | AAA83981.1 |
| 668 | BORDETELLA PERTUSSIS | STSSSRRYTEVY | 1551 | P04977.1 |
| 669 | MEASLES VIRUS STRAIN EDMONSTON | SYFIVLSIAYPTLSE | 1552 | P69353.1 |

-continued

| NO. | DISEASE | EPITOPE AMINO ACID SEQUENCE | SEQ ID NO | ACCESS. NO. |
|---|---|---|---|---|
| 670 | MEASLES VIRUS STRAIN EDMONSTON | SYRETGPSRASDA | 1553 | P04851.1 |
| 671 | BORDETELLA PERTUSSIS | SYVK | 1554 | ACI16083.1 |
| 672 | RUBELLA VIRUS | SYVQHPHKTVRVKFH | 1555 | BAA28178.1 |
| 673 | RUBELLA VIRUS | TAPGPGEV | 1556 | CAJ88851.1 |
| 674 | BORDETELLA PERTUSSIS | TATRLLSSTNSRLC | 1557 | AAA83981.1 |
| 675 | MEASLES MORBILLIVIRUS | TDDPVIDRLYLSSHR | 1558 | P06830.1 |
| 676 | MEASLES VIRUS STRAIN EDMONSTON | TEILSLFGPSLRDPI | 1559 | P69353.1 |
| 677 | RUBELLA VIRUS | TETRTVWQLSVAGVS | 1560 | BAA28178.1 |
| 678 | BORDETELLA PERTUSSIS | TEVYLEHRMQEAVE | 1561 | P04977.1 |
| 679 | MEASLES VIRUS STRAIN EDMONSTON | TFMPEGTVCSQNALY | 1562 | P69353.1 |
| 680 | RUBELLA VIRUS | TGACICEIPTDVSCE | 1563 | BAA28178.1 |
| 681 | BORDETELLA PERTUSSIS | TGDLRAY | 1564 | ACI16083.1 |
| 682 | MEASLES MORBILLIVIRUS | TGMQSWVPLSTDDPV | 1565 | P06830.1 |
| 683 | RUBELLA VIRUS | TGNQQSRWGLGSPNC | 1566 | BAA28178.1 |
| 684 | MEASLES VIRUS STRAIN EDMONSTON | TGPSRASDARAAH | 1567 | P04851.1 |
| 685 | MEASLES MORBILLIVIRUS | TGTIINQDPDKILTY | 1568 | AAF02706.1 |
| 686 | RUBELLA VIRUS | TGVVYGTHTTAVSET | 1569 | BAA28178.1 |
| 687 | MEASLES VIRUS STRAIN EDMONSTON | TIRGQFSNMSLSLLD | 1570 | P08362.1 |
| 688 | RUBELLA VIRUS | TLGATCALPLAGLLA | 1571 | BAA28178.1 |
| 689 | MEASLES MORBILLIVIRUS | TLLNNCTRV | 1572 | P26031.1 |
| 690 | MEASLES VIRUS STRAIN EDMONSTON-B | TLNVPPPPDPGR | 1573 | P03422.1 |
| 691 | MEASLES VIRUS STRAIN EDMONSTON-B | TLNVPPPPDPGRASTSGTPIKK | 1574 | P03422.1 |
| 692 | MEASLES MORBILLIVIRUS | TMTSQGMYGGTYPVE | 1575 | P06830.1 |
| 693 | MEASLES VIRUS STRAIN EDMONSTON | TNLGNAIAKLEDAKE | 1576 | P69353.1 |

-continued

| NO. | DISEASE | EPITOPE AMINO ACID SEQUENCE | SEQ ID NO | ACCESS. NO. |
|---|---|---|---|---|
| 694 | MEASLES VIRUS STRAIN EDMONSTON | TNMEDEADQYFSHDD | 1577 | P04851.1 |
| 695 | MEASLES VIRUS STRAIN EDMONSTON | TNMEDEADQYFSHDDPISSD | 1578 | P04851.1 |
| 696 | RUBELLA VIRUS STRAIN M33 | TNPFQAAVARGLRPP | 1579 | CAA28880.1 |
| 697 | MEASLES MORBILLIVIRUS | TNSIEHQVKDVLTPL | 1580 | P06830.1 |
| 698 | MEASLES VIRUS STRAIN EDMONSTON | TNYLEQPVSNDLSNC | 1581 | P08362.1 |
| 699 | MEASLES MORBILLIVIRUS | TNYLEQPVSNDLSNCMVALGELKLAAL | 1582 | AAR89413.1 |
| 700 | RUBELLA VIRUS | TPERPRLR | 1583 | CAJ88851.1 |
| 701 | RUBELLA VIRUS STRAIN THERIEN | TPERPRLRLVDADDPLLRTA | 1584 | P07566.1 |
| 702 | MEASLES VIRUS STRAIN HALLE | TPGNKPRIA | 1585 | P10050.1 |
| 703 | MEASLES VIRUS STRAIN EDMONSTON | TPLDIDTASESSQDP | 1586 | P04851.1 |
| 704 | MEASLES VIRUS STRAIN EDMONSTON | TPLDIDTASESSQDPQDSRR | 1587 | P04851.1 |
| 705 | MEASLES VIRUS STRAIN EDMONSTON | TPLFKIIGDEVGLRT | 1588 | P08362.1 |
| 706 | MEASLES VIRUS STRAIN EDMONSTON | TPLQCTM | 1589 | P04851.1 |
| 707 | RUBELLA VIRUS | TPVIGSQA | 1590 | CAJ88851.1 |
| 708 | RUBELLA VIRUS | TPVIGSQARK | 1591 | BAA19893.1 |
| 709 | MEASLES VIRUS STRAIN EDMONSTON | TQGYLISNFDESSCT | 1592 | P69353.1 |
| 710 | BORDETELLA PERTUSSIS | TRANPNPYTSRRSVASIVGTLVRM | 1593 | P04977.1 |
| 711 | RUBELLA VIRUS | TRFGCAMRWGLPP | 1594 | NP_740663.1 |
| 712 | BORDETELLA PERTUSSIS | TRNTGQPATDHYYSNV | 1595 | AAA83981.1 |
| 713 | MEASLES VIRUS STRAIN EDMONSTON | TRTPLQCTMTEIF | 1596 | P04851.1 |
| 714 | RUBELLA VIRUS | TRWHRLLRMPVR | 1597 | ABD64216.1 |
| 715 | MEASLES VIRUS STRAIN EDMONSTON | TSGSGGAIRGIKHII | 1598 | P04851.1 |
| 716 | MEASLES VIRUS STRAIN EDMONSTON | TSGSGGAIRGIKHIIIVPIP | 1599 | P04851.1 |

-continued

| NO. | DISEASE | EPITOPE AMINO ACID SEQUENCE | SEQ ID NO | ACCESS. NO. |
|---|---|---|---|---|
| 717 | MEASLES VIRUS STRAIN EDMONSTON | TSQGMYGGTYLVEKP | 1600 | P08362.1 |
| 718 | MEASLES MORBILLIVIRUS | TSRVEHAVVYYVYSP | 1601 | P06830.1 |
| 719 | BORDETELLA PERTUSSIS | TSSSRRYTEVYL | 1602 | ACI04548.1 |
| 720 | BORDETELLA PERTUSSIS | TSYVG | 1603 | ACI16088.1 |
| 721 | MEASLES VIRUS STRAIN EDMONSTON | TTEDKISRAVGPRQA | 1604 | P04851.1 |
| 722 | MEASLES VIRUS STRAIN EDMONSTON | TTEDKISRAVGPRQAQVSFL | 1605 | P04851.1 |
| 723 | RUBELLA VIRUS STRAIN M33 | TTERIETRSARHP | 1606 | ABD64214.1 |
| 724 | MEASLES VIRUS STRAIN EDMONSTON | TTNQAIEAIRQAGQE | 1607 | P69353.1 |
| 725 | RUBELLA VIRUS | TTSDPWHPPGPLGLK | 1608 | BAA28178.1 |
| 726 | MEASLES VIRUS STRAIN EDMONSTON | TVCSQNALYPMSPLL | 1609 | P69353.1 |
| 727 | RUBELLA VIRUS | TVNGEDVGAVPPGKF | 1610 | BAA28178.1 |
| 728 | MEASLES MORBILLIVIRUS | TYPVEKPNLSSKRSE | 1611 | P06830.1 |
| 729 | RUBELLA VIRUS | VAGVSCNVTTEHPFC | 1612 | BAA28178.1 |
| 730 | BORDETELLA PERTUSSIS | VAPGIVIPPKALFTQQGGAYGRC | 1613 | P04979.1 |
| 731 | RUBELLA VIRUS | VCHTKHMDFWCVEHDRPPPATPTPL | 1614 | NP_740663.1 |
| 732 | RUBELLA VIRUS | VCQRHSPDCSRLVGATPER | 1615 | BAA19893.1 |
| 733 | RUBELLA VIRUS | VDADDPLL | 1616 | CAJ88851.1 |
| 734 | RUBELLA VIRUS | VDADDPLLRTAPGPGEVWVT | 1617 | BAA19893.1 |
| 735 | CORYNEBACTERIUM DIPHTHERIAE | VDIGFAAYNFVESIINLFQV | 1618 | AAV70486.1 |
| 736 | MEASLES VIRUS STRAIN EDMONSTON | VEIAEYRRLLRTVLE | 1619 | P69353.1 |
| 737 | MEASLES VIRUS STRAIN EDMONSTON | VELENSMGGLNFGRS | 1620 | P04851.1 |
| 738 | MEASLES VIRUS STRAIN EDMONSTON | VELENSMGGLNFGRSYFDPA | 1621 | P04851.1 |
| 739 | MEASLES MORBILLIVIRUS | VELKIKIASGFGPLI | 1622 | P06830.1 |
| 740 | RUBELLA VIRUS | VEMDEWIHAHTTSD | 1623 | SRC265968 |
| 741 | RUBELLA VIRUS | VEMPEWIHAHTTSDP | 1624 | BAA28178.1 |
| 742 | CORYNEBACTERIUM DIPHTHERIAE | VERRLVKVL | 1625 | P33120.2 |

-continued

| NO. | DISEASE | EPITOPE AMINO ACID SEQUENCE | SEQ ID NO | ACCESS. NO. |
|---|---|---|---|---|
| 743 | MEASLES MORBILLIVIRUS | VESPGQLI | 1626 | ABI54110.1 |
| 744 | MEASLES VIRUS STRAIN EDMONSTON | VESPGQLIQRITDDP | 1627 | P04851.1 |
| 745 | MEASLES VIRUS STRAIN EDMONSTON | VESPGQLIQRITDDPDVSIR | 1628 | P04851.1 |
| 746 | RUBELLA VIRUS | VFALASYVQHPHKTV | 1629 | BAA28178.1 |
| 747 | RUBELLA VIRUS | VGATPERP | 1630 | CAJ88851.1 |
| 748 | RUBELLA VIRUS | VGATPERPRL | 1631 | BAA19893.1 |
| 749 | RUBELLA VIRUS | VGATPERPRLRLVDA | 1632 | BAA28178.1 |
| 750 | MEASLES VIRUS STRAIN EDMONSTON | VGIGSASYKVMTRSS | 1633 | P69353.1 |
| 751 | MEASLES VIRUS STRAIN EDMONSTON | VGLRTPQRFTDLVKF | 1634 | P08362.1 |
| 752 | CORYNEBACTERIUM DIPHTHERIAE | VHHNTEEIVAQSIALSSLMV | 1635 | AAV70486.1 |
| 753 | MEASLES VIRUS STRAIN EDMONSTON | VHRLEGVSYNIGSQE | 1636 | P69353.1 |
| 754 | RUBELLA VIRUS | VIGSQARK | 1637 | CAJ88851.1 |
| 755 | BORDETELLA PERTUSSIS | VITGSI | 1638 | ACI16088.1 |
| 756 | BORDETELLA PERTUSSIS | VITGTI | 1639 | ACI16083.1 |
| 757 | MEASLES VIRUS STRAIN EDMONSTON | VKQSRGEA | 1640 | P04851.1 |
| 758 | MEASLES VIRUS STRAIN EDMONSTON | VLFVMFLSLI | 1641 | P08362.1 |
| 759 | MEASLES MORBILLIVIRUS | VLFVMFLSLIGLLAI | 1642 | P06830.1 |
| 760 | MEASLES MORBILLIVIRUS | VLTPLFKIIGDEVGL | 1643 | P06830.1 |
| 761 | MEASLES VIRUS STRAIN EDMONSTON | VMTRSSHQSLVIKLM | 1644 | P69353.1 |
| 762 | RUBELLA VIRUS | VPAAPCARIWNGTQR | 1645 | BAA28178.1 |
| 763 | RUBELLA VIRUS | VPPDPGDLVEYIMNY | 1646 | BAA28178.1 |
| 764 | MEASLES VIRUS STRAIN EDMONSTON | VQSVASSRRHKRFAG | 1647 | P69353.1 |
| 765 | BORDETELLA PERTUSSIS | VQTGGTSRTVTMRYLAS | 1648 | ACI16083.1 |
| 766 | BORDETELLA PERTUSSIS | VQVRI | 1649 | ACI16083.1 |
| 767 | RUBELLA VIRUS | VRAYNQPAGDV | 1650 | NP_740662.1 |

-continued

| NO. | DISEASE | EPITOPE AMINO ACID SEQUENCE | SEQ ID NO | ACCESS. NO. |
|---|---|---|---|---|
| 768 | RUBELLA VIRUS | VRFESKIVDGGCFAP | 1651 | BAA28178.1 |
| 769 | RUBELLA VIRUS | VRLAGVRFESKIVDG | 1652 | BAA28178.1 |
| 770 | MEASLES VIRUS STRAIN EDMONSTON | VSGSFGNRFILSQGN | 1653 | P69353.1 |
| 771 | BORDETELLA PERTUSSIS | VSKEEQYYDYEDAT | 1654 | AAA83981.1 |
| 772 | MEASLES VIRUS STRAIN EDMONSTON | VSKGNCSGPTTIRGQ | 1655 | P08362.1 |
| 773 | RUBELLA VIRUS | VTAALLNTPPPYQVS | 1656 | BAA28178.1 |
| 774 | RUBELLA VIRUS | VTGCYQCGTPALVEG | 1657 | BAA28178.1 |
| 775 | RUBELLA VIRUS | VTPVIGSQ | 1658 | CAJ88851.1 |
| 776 | RUBELLA VIRUS STRAIN THERIEN | VTTEHPFCNTPHGQLEVQVPPD | 1659 | P07566.1 |
| 777 | MEASLES VIRUS STRAIN EDMONSTON | VVLAGAALGVATAAQ | 1660 | P69353.1 |
| 778 | RUBELLA VIRUS | VWQLSVAGVSCNVTT | 1661 | BAA28178.1 |
| 779 | RUBELLA VIRUS | VWVTPVIG | 1662 | CAJ88851.1 |
| 780 | RUBELLA VIRUS | VWVTPVIGSQAR | 1663 | BAA19893.1 |
| 781 | MEASLES VIRUS STRAIN EDMONSTON | VYILIAVCLGGLIGI | 1664 | P69353.1 |
| 782 | MEASLES VIRUS STRAIN EDMONSTON | VYLHRIDLGPPISLE | 1665 | P69353.1 |
| 783 | BORDETELLA PERTUSSIS | VYRYDSRP | 1666 | P04977.1 |
| 784 | BORDETELLA PERTUSSIS | VYRYDSRPPEDV | 1667 | P04977.1 |
| 785 | MEASLES MORBILLIVIRUS | VYWLTIPPMKNLALG | 1668 | P06830.1 |
| 786 | RUBELLA VIRUS | WDLEATGACICEIPT | 1669 | BAA28178.1 |
| 787 | MEASLES MORBILLIVIRUS | WDQKLWCRHFCVLAD | 1670 | AAR89413.1 |
| 788 | RUBELLA VIRUS | WGFPTDTVMSVFALA | 1671 | BAA28178.1 |
| 789 | RUBELLA VIRUS | WHPPGPLGLKFKTVR | 1672 | BAA28178.1 |
| 790 | RUBELLA VIRUS | WIHAHTTSDPWHPPG | 1673 | BAA28178.1 |
| 791 | MEASLES VIRUS STRAIN EDMONSTON | WLTIPPMKNLALGVI | 1674 | P08362.1 |
| 792 | MEASLES VIRUS STRAIN EDMONSTON | WQESRKNKAQTRTPLQCTMT | 1675 | P04851.1 |
| 793 | RUBELLA VIRUS | WVCIFMVCRRACR | 1676 | SRC265968 |
| 794 | RUBELLA VIRUS | WVTPVIGS | 1677 | CAJ88851.1 |

| NO. | DISEASE | EPITOPE AMINO ACID SEQUENCE | SEQ ID NO | ACCESS. NO. |
|---|---|---|---|---|
| 795 | MEASLES VIRUS STRAIN EDMONSTON | WYTTVPKYVATQGYL | 1678 | P69353.1 |
| 796 | MEASLES VIRUS STRAIN EDMONSTON | YALGGDINKVLEKLG | 1679 | P69353.1 |
| 797 | MEASLES VIRUS STRAIN EDMONSTON | YAMGVGVELE | 1680 | P04851.1 |
| 798 | MEASLES MORBILLIVIRUS | YAMGVGVELEN | 1681 | ABI54110.1 |
| 799 | MEASLES MORBILLIVIRUS | YCADVAAEELMNALV | 1682 | AAR89413.1 |
| 800

-continued

| NO. | DISEASE | EPITOPE AMINO ACID SEQUENCE | SEQ ID NO | ACCESS. NO. |
|---|---|---|---|---|
| 818 | MEASLES VIRUS STRAIN EDMONSTON | YPFRLPIKGVPIELQ | 1701 | P08362.1 |
| 819 | MEASLES VIRUS STRAIN HALLE | YPLLWSYAM | 1702 | P10050.1 |
| 820 | MUMPS RUBULAVIRUS | YQQQGRL | 1703 | P21186.1 |
| 821 | BORDETELLA PERTUSSIS | YQSEYLAHRR | 1704 | P04977.1 |
| 822 | MEASLES VIRUS STRAIN EDMONSTON | YRETGPSRASDARAA | 1705 | P04851.1 |
| 823 | MEASLES VIRUS STRAIN EDMONSTON | YRETGPSRASDARAAHLPTG | 1706 | P04851.1 |
| 824 | RUBELLA VIRUS | YRNASDVLPGHWLQGGWGCYNLSDW | 1707 | NP_740663.1 |
| 825 | MEASLES VIRUS STRAIN EDMONSTON | YRRLLRTVLEPIRDA | 1708 | P69353.1 |
| 826 | BORDETELLA PERTUSSIS | YRYDSRPP | 1709 | P04977.1 |
| 827 | MEASLES VIRUS STRAIN EDMONSTON | YSGGDLLGILESRGI | 1710 | P69353.1 |
| 828 | BORDETELLA PERTUSSIS | YSKVTATBLLASTNSRLCAVFVRDG | 1711 | SRC280066 |
| 829 | MEASLES VIRUS STRAIN EDMONSTON | YSPSRSFSYFYPFRL | 1712 | P08362.1 |
| 830 | RUBELLA VIRUS STRAIN THERIEN | YTGNQQSRWGLGSPNCHGPDWASPV | 1713 | P07566.1 |
| 831 | MEASLES MORBILLIVIRUS | YVLLAVLFV | 1714 | P08362.1 |
| 832 | MEASLES MORBILLIVIRUS | YVYSPGRSFSYFYPF | 1715 | P06830.1 |
| 833 | BORDETELLA PERTUSSIS | YYDYEDATFQTYALTGISLCNPAASIC | 1716 | P04979.1 |
| 834 | MEASLES MORBILLIVIRUS | GDLLGILESRGIKAR | 1717 | AAF02706.1 |
| 835 | MEASLES MORBILLIVIRUS | TVPKYVATQGYLISN | 1718 | AAL29688.1 |
| 836 | MEASLES MORBILLIVIRUS | KPWDSPQEI | 1719 | P26035.1 |
| 837 | MEASLES MORBILLIVIRUS | KPWESPQEI | 1720 | CAA34579.1 |
| 838 | BORDETELLA PERTUSSIS | ATYQSEYLAHRRIPP | 1721 | ACI04548.1 |
| 839 | BORDETELLA PERTUSSIS | CMARQAESSEAMAAWSERAGEAMVLVYYESIAYSF | 1722 | ACI04548.1 |
| 840 | BORDETELLA PERTUSSIS | CQVGSSNSAFVSTSSSRRYTEVYL | 1723 | ACI04548.1 |

-continued

| NO. | DISEASE | EPITOPE AMINO ACID SEQUENCE | SEQ ID NO | ACCESS. NO. |
|---|---|---|---|---|
| 841 | BORDETELLA PERTUSSIS | DDPPATVYRYDSRPP | 1724 | ACI04548.1 |
| 842 | BORDETELLA PERTUSSIS | GALATYQSEYLAHRRIPP | 1725 | ACI04548.1 |
| 843 | BORDETELLA PERTUSSIS | MAAWSERAGEAMVLVYYESIAYSF | 1726 | ACI04548.1 |
| 844 | BORDETELLA PERTUSSIS | MVLVYYESIAYSF | 1727 | ACI04548.1 |
| 845 | BORDETELLA PERTUSSIS | PATVYRYDSRPPEDV | 1728 | ACI04548.1 |
| 846 | BORDETELLA PERTUSSIS | YDSRPPEDV | 1729 | ACI04548.1 |
| 847 | BORDETELLA PERTUSSIS | EPGITTNYDT | 1730 | ACI16087.1 |
| 848 | BORDETELLA PERTUSSIS | GDLRAYKMVYATNPQTQLSN | 1731 | ACI16083.1 |
| 849 | BORDETELLA PERTUSSIS | KNGDVEASAITTYVGFSVVYP | 1732 | ACI16083.1 |
| 850 | BORDETELLA PERTUSSIS | KVTNGSKSYTLRYLASYVK | 1733 | ACI16088.1 |
| 851 | BORDETELLA PERTUSSIS | QALGALKLYFEPGITTNYDTGDLIAYKQTYNASGN | 1734 | ACI16088.1 |
| 852 | BORDETELLA PERTUSSIS | YATNPQTQLS | 1735 | ACI16083.1 |
| 853 | CORYNEBACTERIUM DIPHTHERIAE | DNENPLSGKAGGVVKVTYPGLTKV | 1736 | AAV70486.1 |
| 854 | CORYNEBACTERIUM DIPHTHERIAE | ENFSSYHGTKPGYVDSI | 1737 | AAV70486.1 |
| 855 | CORYNEBACTERIUM DIPHTHERIAE | KVDNAETIKKELGLSLTEP | 1738 | AAV70486.1 |
| 856 | RUBELLA VIRUS STRAIN M33 | MEDLQKALEAQSRALRAGLAA | 1739 | CAA28880.1 |
| 857 | CORYNEBACTERIUM DIPHTHERIAE | QKGIQKPKSGTQGNYDDDWKGFY | 1740 | AAV70486.1 |
| 858 | RUBELLA VIRUS STRAIN M33 | RTGAWQRKDWSRAPPPPEERQESRSQTPAPKPSR | 1741 | CAA28880.1 |
| 859 | RUBELLA VIRUS | AAGASQSRRPRPPRHARAQHLPEMTPAVT | 1742 | SRC265968 |
| 860 | RUBELLA VIRUS | CVTSWLWSEGEGAVFYRVDLHFINLGTP | 1743 | CAA28880.1 |
| 861 | RUBELLA VIRUS | FRVGGTRWHRLLRMPVRGLDGDTAPLP | 1744 | CAA28880.1 |
| 862 | CORYNEBACTERIUM DIPHTHERIAE | GRKIRMRCRAIDGDVTFCRPKSPVYVGN | 1745 | 1007216A |
| 863 | RUBELLA VIRUS | GTPPLDEDGRWDPALMYNPCGPEPPAHV | 1746 | CAA28880.1 |
| 864 | CORYNEBACTERIUM DIPHTHERIAE | GVHANLHVAFHRSSSEKIHSNEISSDSIGVLGYQKTVDHTKVNSKLSLFFEIKS | 1747 | AAV70486.1 |
| 865 | RUBELLA VIRUS | MASTTPITMEDLQKALEAQSRALRAGLAAG | 1748 | ABD64200.1 |

-continued

| NO. | DISEASE | EPITOPE AMINO ACID SEQUENCE | SEQ ID NO | ACCESS. NO. |
|---|---|---|---|---|
| 866 | RUBELLA VIRUS | PELGPPTNPFQAAVARGLRPPLHDPDTEAPTEAC | 1749 | CAA28880.1 |
| 867 | RUBELLA VIRUS | PLPPHTTERIETRSARHPWRIRFGAP | 1750 | CAA28880.1 |
| 868 | RUBELLA VIRUS | SRAPPPPEERQESRSQTPAPKPSRAPP | 1751 | CAA28880.1 |
| 869 | RUBELLA VIRUS | SRAPPQQPQPPRMQTGRGGSAPRPELGP | 1752 | CAA28880.1 |
| 870 | RUBELLA VIRUS | TPAVTPEGPAPPRTGAWQRKDWSRAPP | 1753 | CAA28880.1 |
| 871 | RUBELLA VIRUS | VRAYNQPAGDVRGVWGKGERTYAEQDFRV | 1754 | CAA28880.1 |
| 872 | RUBELLA VIRUS | AFGHSDAACWGFPTDTVMSV | 1755 | CAA28880.1 |
| 873 | RUBELLA VIRUS | CARIWNGTQRACTFWAVNAYS | 1756 | CAA28880.1 |
| 874 | RUBELLA VIRUS | EEAFTYLCTAPGCATQTPVPVR | 1757 | CAA28880.1 |
| 875 | RUBELLA VIRUS | FAPWDLEATGACICEIPTDV | 1758 | CAA28880.1 |
| 876 | RUBELLA VIRUS | GEDVGAFPPGKFVTAAL | 1759 | CAA28880.1 |
| 877 | RUBELLA VIRUS | GEVWVTPVIGSQARKCGLHI | 1760 | CAA28880.1 |
| 878 | RUBELLA VIRUS | GQLEVQVPPDPGDLVEYIMN | 1761 | CAA28880.1 |
| 879 | RUBELLA VIRUS | GSYYKQYHPTACEVEPAFGH | 1762 | CAA28880.1 |
| 880 | RUBELLA VIRUS | IHAHTTSDPWHPPGPLGLKF | 1763 | CAA28880.1 |
| 881 | RUBELLA VIRUS | IMNYTGNQQSRWGLGSPNCH | 1764 | CAA28880.1 |
| 882 | RUBELLA VIRUS | LHIRAGPYGHATVEMPEWIH | 1765 | CAA28880.1 |
| 883 | RUBELLA VIRUS | LKFKTVRPVALPRALAPPRN | 1766 | CAA28880.1 |
| 884 | RUBELLA VIRUS | LNTPPPYQVSCGGESDRASAGH | 1767 | CAA28880.1 |
| 885 | RUBELLA VIRUS | NCHGPDWASPVCQRHSPDCS | 1768 | CAA28880.1 |
| 886 | RUBELLA VIRUS | PDCSRLVGATPERPRLRLVD | 1769 | CAA28880.1 |
| 887 | RUBELLA VIRUS | PRNVRVTGCYQCGTPALVEG | 1770 | CAA28880.1 |
| 888 | RUBELLA VIRUS | PTDVSCEGLGAWVPTAPCARI | 1771 | CAA28880.1 |
| 889 | RUBELLA VIRUS | RLVDADDPLLRTAPGPGEVW | 1772 | CAA28880.1 |
| 890 | RUBELLA VIRUS | SVFALASYVQHPHKTVRVKF | 1773 | CAA28880.1 |
| 891 | RUBELLA VIRUS | VEGLAPGGGNCHLTVNGEDV | 1774 | CAA28880.1 |
| 892 | RUBELLA VIRUS | VKFHTETRTVWQLSVAGVSC | 1775 | CAA28880.1 |
| 893 | RUBELLA VIRUS | VPVRLAGVGFESKIVDGGCF | 1776 | CAA28880.1 |
| 894 | RUBELLA VIRUS | VSCNVTTEHPFCNTPHGQLE | 1777 | CAA28880.1 |
| 895 | BORDETELLA PERTUSSIS | AAASSPDAHVPF | 1778 | AAA22983.1 |
| 896 | BORDETELLA PERTUSSIS | AASSPDA | 1779 | AAA22983.1 |
| 897 | BORDETELLA PERTUSSIS | AKLGAAASSPDA | 1780 | AAA22983.1 |
| 898 | BORDETELLA PERTUSSIS | AMKPYEVTPTRM | 1781 | AAA22983.1 |
| 899 | BORDETELLA PERTUSSIS | AMTHLSPALADVPYVLVKTNMVVTS | 1782 | AAA22983.1 |

| NO. | DISEASE | EPITOPE AMINO ACID SEQUENCE | SEQ ID NO | ACCESS. NO. |
|---|---|---|---|---|
| 900 | BORDETELLA PERTUSSIS | ASSPDAHVPFCF | 1783 | AAA22983.1 |
| 901 | BORDETELLA PERTUSSIS | ASSPDAHVPFCFGKDLKRPGSSPME | 1784 | AAA22983.1 |
| 902 | BORDETELLA PERTUSSIS | CFGKDLKRPGSS | 1785 | AAA22983.1 |
| 903 | BORDETELLA PERTUSSIS | CFGKDLKRPGSSPMEVMLRAVFMQQ | 1786 | AAA22983.1 |
| 904 | BORDETELLA PERTUSSIS | CGIAAKLGAAAS | 1787 | AAA22983.1 |
| 905 | BORDETELLA PERTUSSIS | CGIAAKLGAAASSPDAHVPFCFGKD | 1788 | AAA22983.1 |
| 906 | BORDETELLA PERTUSSIS | DAHVPFCFGKDL | 1789 | AAA22983.1 |
| 907 | BORDETELLA PERTUSSIS | DLKRPGSSPMEV | 1790 | AAA22983.1 |
| 908 | BORDETELLA PERTUSSIS | DVPYVLVKTNMV | 1791 | AAA22983.1 |
| 909 | BORDETELLA PERTUSSIS | DVPYVLVKTNMVVTSVAMKPYEVTPT | 1792 | AAA22983.1 |
| 910 | BORDETELLA PERTUSSIS | EVMLRAVFMQQR | 1793 | AAA22983.1 |
| 911 | BORDETELLA PERTUSSIS | FEGKPALELIRM | 1794 | AAA22983.1 |
| 912 | BORDETELLA PERTUSSIS | FLGPKQLTFEGK | 1795 | AAA22983.1 |
| 913 | BORDETELLA PERTUSSIS | FLGPKQLTFEGKPALELIRMVECSG | 1796 | AAA22983.1 |
| 914 | BORDETELLA PERTUSSIS | FMQQRPLRMFLGPKQLT | 1797 | AAA22983.1 |
| 915 | BORDETELLA PERTUSSIS | GKDLKRPGSSPM | 1798 | AAA22983.1 |
| 916 | BORDETELLA PERTUSSIS | GKDLKRPGSSPME | 1799 | AAA22983.1 |
| 917 | BORDETELLA PERTUSSIS | GKPALELIRMVE | 1800 | AAA22983.1 |
| 918 | BORDETELLA PERTUSSIS | GPKQLTFEGKPA | 1801 | AAA22983.1 |
| 919 | BORDETELLA PERTUSSIS | HVPFCFGKDLKR | 1802 | AAA22983.1 |
| 920 | BORDETELLA PERTUSSIS | IAAKLGAAASSP | 1803 | AAA22983.1 |
| 921 | BORDETELLA PERTUSSIS | KPYEVTPTRMLV | 1804 | AAA22983.1 |
| 922 | BORDETELLA PERTUSSIS | KQLTFEGKPALE | 1805 | AAA22983.1 |
| 923 | BORDETELLA PERTUSSIS | KRPGSSPMEVML | 1806 | AAA22983.1 |
| 924 | BORDETELLA PERTUSSIS | LELIRMVECSGK | 1807 | AAA22983.1 |

-continued

| NO. | DISEASE | EPITOPE AMINO ACID SEQUENCE | SEQ ID NO | ACCESS. NO. |
|---|---|---|---|---|
| 925 | BORDETELLA PERTUSSIS | LGAAASSPDAHV | 1808 | AAA22983.1 |
| 926 | BORDETELLA PERTUSSIS | LIRMVECSGKQD | 1809 | AAA22983.1 |
| 927 | BORDETELLA PERTUSSIS | LVCGIAAKLGAA | 1810 | AAA22983.1 |
| 928 | BORDETELLA PERTUSSIS | MKPYEVTPTRM | 1811 | AAA22983.1 |
| 929 | BORDETELLA PERTUSSIS | MLRAVFMQQRPL | 1812 | AAA22983.1 |
| 930 | BORDETELLA PERTUSSIS | MQQRPLRM | 1813 | AAA22983.1 |
| 931 | BORDETELLA PERTUSSIS | MQQRPLRMFLGP | 1814 | AAA22983.1 |
| 932 | BORDETELLA PERTUSSIS | MVVTSVAMKPYE | 1815 | AAA22983.1 |
| 933 | BORDETELLA PERTUSSIS | MVVTSVAMKPYEVTPTRMLVCGIAA | 1816 | AAA22983.1 |
| 934 | BORDETELLA PERTUSSIS | PALELIRMVECS | 1817 | AAA22983.1 |
| 935 | BORDETELLA PERTUSSIS | PALELIRMVECSGK | 1818 | AAA22983.1 |
| 936 | BORDETELLA PERTUSSIS | PFCFGKDLKRPG | 1819 | AAA22983.1 |
| 937 | BORDETELLA PERTUSSIS | PGSSPMEVMLRA | 1820 | AAA22983.1 |
| 938 | BORDETELLA PERTUSSIS | PGSSPMEVMLRAVF | 1821 | AAA22983.1 |
| 939 | BORDETELLA PERTUSSIS | PKQLTFEGK | 1822 | AAA22983.1 |
| 940 | BORDETELLA PERTUSSIS | PLRMFLGPKQLT | 1823 | AAA22983.1 |
| 941 | BORDETELLA PERTUSSIS | PTRMLVCGIAAK | 1824 | AAA22983.1 |
| 942 | BORDETELLA PERTUSSIS | PYVLVKTNMVVT | 1825 | AAA22983.1 |
| 943 | BORDETELLA PERTUSSIS | QLTFEGKPALELIRMVECSGKQDCP | 1826 | AAA22983.1 |
| 944 | BORDETELLA PERTUSSIS | QRPLRMFLGPKQ | 1827 | AAA22983.1 |
| 945 | BORDETELLA PERTUSSIS | RAVFMQQRPLRM | 1828 | AAA22983.1 |
| 946 | BORDETELLA PERTUSSIS | RMFLGPKQLTFE | 1829 | AAA22983.1 |
| 947 | BORDETELLA PERTUSSIS | RMLVCGIAAKLG | 1830 | AAA22983.1 |
| 948 | BORDETELLA PERTUSSIS | RMVECSGKQDCP | 1831 | AAA22983.1 |
| 949 | BORDETELLA PERTUSSIS | SPDAHVPFCFGK | 1832 | AAA22983.1 |

-continued

| NO. | DISEASE | EPITOPE AMINO ACID SEQUENCE | SEQ ID NO | ACCESS. NO. |
|---|---|---|---|---|
| 950 | BORDETELLA PERTUSSIS | SSPMEVMLRAVF | 1833 | AAA22983.1 |
| 951 | BORDETELLA PERTUSSIS | SSPMEVMLRAVFMQQRPLRMFLGPK | 1834 | AAA22983.1 |
| 952 | BORDETELLA PERTUSSIS | SVAMKPYEVTPT | 1835 | AAA22983.1 |
| 953 | BORDETELLA PERTUSSIS | VECSGKQDCP | 1836 | AAA22983.1 |
| 954 | BORDETELLA PERTUSSIS | VFMQQRPLRMFL | 1837 | AAA22983.1 |
| 955 | BORDETELLA PERTUSSIS | VFMQQRPLRMFLGPKQLTFEGKPAL | 1838 | AAA22983.1 |
| 956 | BORDETELLA PERTUSSIS | VKTNMVVTSVAM | 1839 | AAA22983.1 |
| 957 | BORDETELLA PERTUSSIS | VLVKTNMVVTSV | 1840 | AAA22983.1 |
| 958 | BORDETELLA PERTUSSIS | VTPTRMLVCGIA | 1841 | AAA22983.1 |
| 959 | BORDETELLA PERTUSSIS | VTSVAMKPYEVT | 1842 | AAA22983.1 |
| 960 | BORDETELLA PERTUSSIS | YEVTPTRMLVCG | 1843 | AAA22983.1 |
| 961 | BORDETELLA PERTUSSIS | YEVTPTRMLVCGIAAKLGAAASSPD | 1844 | AAA22983.1 |
| 962 | BORDETELLA PERTUSSIS | CASPYEGRYRDMYDALR | 1845 | P04979.1 |
| 963 | BORDETELLA PERTUSSIS | CAVFVRDGQSV | 1846 | P04979.1 |
| 964 | BORDETELLA PERTUSSIS | CITTIYKTG | 1847 | P04979.1 |
| 965 | BORDETELLA PERTUSSIS | CPNGTRALTV | 1848 | P04979.1 |
| 966 | BORDETELLA PERTUSSIS | DALRRLLYMIYMSG | 1849 | P04979.1 |
| 967 | RUBELLA VIRUS STRAIN THERIEN | GNRGRGQRRDWSRAPPPPEERQETRS | 1850 | P07566.1 |
| 968 | BORDETELLA PERTUSSIS | GQPAADHYYSKVT | 1851 | P04979.1 |
| 969 | RUBELLA VIRUS | GSPNCHGPDWASPVCQRHS | 1852 | ABD64214.1 |
| 970 | MEASLES VIRUS STRAIN EDMONSTON | HKSLSTNLDVTNSIEHQ | 1853 | P08362.1 |
| 971 | BORDETELLA PERTUSSIS | LFTQQGGAYGRC | 1854 | P04979.1 |
| 972 | MEASLES VIRUS STRAIN EDMONSTON | LIGLLAIAGIRLHRAAIYTAEI | 1855 | P08362.1 |
| 973 | MEASLES MORBILLIVIRUS | PDTAADSELRRWIKY | 1856 | ABI54110.1 |
| 974 | RUBELLA VIRUS STRAIN THERIEN | PNCHGPDWASPVCQRHS | 1857 | P07566.1 |

| NO. | DISEASE | EPITOPE AMINO ACID SEQUENCE | SEQ ID NO | ACCESS. NO. |
|---|---|---|---|---|
| 975 | RUBELLA VIRUS | QTPAPKPSRAPPQQPQPPRMQTGR | 1858 | ABD64216.1 |
| 976 | RUBELLA VIRUS VACCINE STRAIN RA27/3 | RAGLTAGASQSRRPRPPR | 1859 | CAA33016.1 |
| 977 | RUBELLA VIRUS VACCINE STRAIN RA27/3 | RFGAPQAFLAGLLLAAVAVGTARA | 1860 | ABD64214.1 |
| 978 | BORDETELLA PERTUSSIS | RGNAELQTYLRQITPG | 1861 | P04979.1 |
| 979 | BORDETELLA PERTUSSIS | RVHVSKEEQYYDYED | 1862 | P04979.1 |
| 980 | BORDETELLA PERTUSSIS | SIYGLYDGTYL | 1863 | P04979.1 |
| 981 | BORDETELLA PERTUSSIS | SKVTATRLLASTNS | 1864 | P04979.1 |
| 982 | BORDETELLA PERTUSSIS | TQQGGAYGRCPNGTRA | 1865 | P04979.1 |
| 983 | BORDETELLA PERTUSSIS | VAPGIVIPPKAL | 1866 | P04979.1 |
| 984 | BORDETELLA PERTUSSIS | DSRPPEDVFQNGFTAWG | 1867 | ACI04548.1 |
| 985 | BORDETELLA PERTUSSIS | EHRMQEAVEAERAGR | 1868 | ACI04548.1 |
| 986 | MEASLES VIRUS STRAIN EDMONSTON | ETCFQQACKGKIQALCENPEWA | 1869 | P08362.1 |
| 987 | BORDETELLA PERTUSSIS | EYVDTYGDNAGRILAGALATYQ | 1870 | ACI04548.1 |
| 988 | BORDETELLA PERTUSSIS | HRRIPPENIRRVTR | 1871 | ACI04548.1 |
| 989 | BORDETELLA PERTUSSIS | MARQAESSE | 1872 | ACI04548.1 |
| 990 | BORDETELLA PERTUSSIS | MQEAVEAERAGR | 1873 | ACI04548.1 |
| 991 | BORDETELLA PERTUSSIS | SQQTRANPNPYTSRR | 1874 | ACI04548.1 |
| 992 | BORDETELLA PERTUSSIS | TRANPNPYTSRRSVASIVGTLVHG | 1875 | SRC280066 |
| 993 | BORDETELLA PERTUSSIS | TVYRYDSRPPED | 1876 | ACI04548.1 |
| 994 | MEASLES MORBILLIVIRUS | NDRNLLD | 1877 | P10050.1 |
| 995 | MEASLES MORBILLIVIRUS | NMEDEADQYFSHDDPISSDQSRFGWFENK | 1878 | P04851.1 |
| 996 | MEASLES MORBILLIVIRUS | SRASDARAAHLPTGTPLDID | 1879 | P04851.1 |
| 997 | BORDETELLA PERTUSSIS | EDVFQNGFTAW | 1880 | ACI04548.1 |
| 998 | CORYNEBACTERIUM DIPHTHERIAE | AEGSSSVEYINNWEQAK | 1881 | AAV70486.1 |
| 999 | CORYNEBACTERIUM DIPHTHERIAE | GPIKNKMSESPNKT | 1882 | AAV70486.1 |

| NO. | DISEASE | EPITOPE AMINO ACID SEQUENCE | SEQ ID NO | ACCESS. NO. |
|---|---|---|---|---|
| 1000 | MEASLES VIRUS STRAIN HALLE | GPKLTGALIGILSLFVESPGQLIQRITD DPDV | 1883 | P10050.1 |
| 1001 | CORYNEBACTERIUM DIPHTHERIAE | GYQKTVDHTKVNSK | 1884 | AAV70486.1 |
| 1002 | CORYNEBACTERIUM DIPHTHERIAE | KTVDH | 1885 | AAV70486.1 |
| 1003 | CORYNEBACTERIUM DIPHTHERIAE | SESPNK | 1886 | AAV70486.1 |
| 1004 | CORYNEBACTERIUM DIPHTHERIAE | AEGSSSVEYINNWEQAKALS | 1887 | AAV70486.1 |
| 1005 | CORYNEBACTERIUM DIPHTHERIAE | AQAIPLVGELVDIGFAAYNF | 1888 | AAV70486.1 |
| 1006 | CORYNEBACTERIUM DIPHTHERIAE | ASRVVLSLPFAEGSSSVEYI | 1889 | AAV70486.1 |
| 1007 | CORYNEBACTERIUM DIPHTHERIAE | CINLDWDVIRDKTKTKIESL | 1890 | AAV70486.1 |
| 1008 | CORYNEBACTERIUM DIPHTHERIAE | CRAIDGDVTFCRPKSPVYVG | 1891 | AAV70486.1 |
| 1009 | CORYNEBACTERIUM DIPHTHERIAE | CRPKSPVYVGNGVHANLHVA | 1892 | AAV70486.1 |
| 1010 | CORYNEBACTERIUM DIPHTHERIAE | DAAGYSVDNENPLSGKAGGV | 1893 | AAV70486.1 |
| 1011 | CORYNEBACTERIUM DIPHTHERIAE | DKTKTKIESLKEHGPIKNKM | 1894 | AAV70486.1 |
| 1012 | CORYNEBACTERIUM DIPHTHERIAE | EEFIKRFGDGASRVVLSLPF | 1895 | AAV70486.1 |
| 1013 | CORYNEBACTERIUM DIPHTHERIAE | EKAKQYLEEFHQTALEHPEL | 1896 | AAV70486.1 |
| 1014 | CORYNEBACTERIUM DIPHTHERIAE | FHRSSSEKIHSNEISSDSIG | 1897 | AAV70486.1 |
| 1015 | CORYNEBACTERIUM DIPHTHERIAE | GADDVVDSSKSFVMENFSSY | 1898 | CAE11230.1 |
| 1016 | CORYNEBACTERIUM DIPHTHERIAE | GKRGQDAMYEYMAQACAGNR | 1899 | AAV70486.1 |
| 1017 | CORYNEBACTERIUM DIPHTHERIAE | GSVMGIADGAVHHNTEEIVA | 1900 | AAV70486.1 |
| 1018 | CORYNEBACTERIUM DIPHTHERIAE | GTQGNYDDDWKGFYSTDNKY | 1901 | AAV70486.1 |
| 1019 | CORYNEBACTERIUM DIPHTHERIAE | HDGYAVSWNTVEDSIIRTGF | 1902 | AAV70486.1 |
| 1020 | CORYNEBACTERIUM DIPHTHERIAE | HGTKPGYVDSIQKGIQKPKS | 1903 | AAV70486.1 |
| 1021 | CORYNEBACTERIUM DIPHTHERIAE | HQTALEHPELSELKTVTGTN | 1904 | AAV70486.1 |
| 1022 | CORYNEBACTERIUM DIPHTHERIAE | IQKGIQKPKSGTQGNYDDDW | 1905 | AAV70486.1 |
| 1023 | CORYNEBACTERIUM DIPHTHERIAE | KEHGPIKNKMSESPNKTVSE | 1906 | AAV70486.1 |
| 1024 | CORYNEBACTERIUM DIPHTHERIAE | KGFYSTDNKYDAAGYSVDNE | 1907 | AAV70486.1 |

-continued

| NO. | DISEASE | EPITOPE AMINO ACID SEQUENCE | SEQ ID NO | ACCESS. NO. |
|---|---|---|---|---|
| 1025 | CORYNEBACTERIUM DIPHTHERIAE | LDVNKSKTHISVNGRKIRMR | 1908 | AAV70486.1 |
| 1026 | RUBELLA VIRUS | MASTIPITMEDLQKALEA | 1909 | SRC265968 |
| 1027 | CORYNEBACTERIUM DIPHTHERIAE | NGVHANLHVAFHRSSSEKIH | 1910 | AAV70486.1 |
| 1028 | CORYNEBACTERIUM DIPHTHERIAE | NNWEQAKALSVELEINFETR | 1911 | AAV70486.1 |
| 1029 | CORYNEBACTERIUM DIPHTHERIAE | NPLSGKAGGVVKVTYPGLTK | 1912 | AAV70486.1 |
| 1030 | CORYNEBACTERIUM DIPHTHERIAE | PVFAGANYAAWAVNVAQVID | 1913 | AAV70486.1 |
| 1031 | CORYNEBACTERIUM DIPHTHERIAE | SELKTVTGTNPVFAGANYAA | 1914 | AAV70486.1 |
| 1032 | CORYNEBACTERIUM DIPHTHERIAE | SESPNKTVSEEKAKQYLEEF | 1915 | AAV70486.1 |
| 1033 | CORYNEBACTERIUM DIPHTHERIAE | SETADNLEKTTAALSILPGI | 1916 | AAV70486.1 |
| 1034 | CORYNEBACTERIUM DIPHTHERIAE | SFVMENFSSYHGTKPGYVDS | 1917 | AAV70486.1 |
| 1035 | CORYNEBACTERIUM DIPHTHERIAE | SNEISSDSIGVLGYQKTVDH | 1918 | AAV70486.1 |
| 1036 | CORYNEBACTERIUM DIPHTHERIAE | SPGHKTQPFLHDGYAVSWNT | 1919 | AAV70486.1 |
| 1037 | CORYNEBACTERIUM DIPHTHERIAE | SVNGRKIRMRCRAIDGDVTF | 1920 | AAV70486.1 |
| 1038 | CORYNEBACTERIUM DIPHTHERIAE | TAALSILPGIGSVMGIADGA | 1921 | AAV70486.1 |
| 1039 | CORYNEBACTERIUM DIPHTHERIAE | TAENTPLPIAGVLLPTIPGK | 1922 | AAV70486.1 |
| 1040 | CORYNEBACTERIUM DIPHTHERIAE | TEPLMEQVGTEEFIKRFGDG | 1923 | AAV70486.1 |
| 1041 | CORYNEBACTERIUM DIPHTHERIAE | TIKKELGLSLTEPLMEQVGT | 1924 | AAV70486.1 |
| 1042 | CORYNEBACTERIUM DIPHTHERIAE | TKVNSKLSLFFEIKS | 1925 | AAV70486.1 |
| 1043 | CORYNEBACTERIUM DIPHTHERIAE | VEDSIIRTGFQGESGHDIKI | 1926 | AAV70486.1 |
| 1044 | CORYNEBACTERIUM DIPHTHERIAE | VELEINFETRGKRGQDAMYE | 1927 | AAV70486.1 |
| 1045 | CORYNEBACTERIUM DIPHTHERIAE | VESIINLFQVVHNSYNRPAY | 1928 | AAV70486.1 |
| 1046 | CORYNEBACTERIUM DIPHTHERIAE | VHNSYNRPAYSPGHKTQPFL | 1929 | AAV70486.1 |
| 1047 | CORYNEBACTERIUM DIPHTHERIAE | VKVTYPGLTKVLALKVDNAE | 1930 | AAV70486.1 |
| 1048 | CORYNEBACTERIUM DIPHTHERIAE | VLALKVDNAETIKKELGLSL | 1931 | AAV70486.1 |
| 1049 | CORYNEBACTERIUM DIPHTHERIAE | VLGYQKTVDHTKVNSKLSLF | 1932 | AAV70486.1 |
| 1050 | CORYNEBACTERIUM DIPHTHERIAE | VRRSVGSSLSCINLDWDVIR | 1933 | AAV70486.1 |

-continued

| NO. | DISEASE | EPITOPE AMINO ACID SEQUENCE | SEQ ID NO | ACCESS. NO. |
|---|---|---|---|---|
| 1051 | CORYNEBACTERIUM DIPHTHERIAE | WAVNVAQVIDSETADNLEKT | 1934 | AAV70486.1 |
| 1052 | CORYNEBACTERIUM DIPHTHERIAE | YMAQACAGNRVRRSVGSSLS | 1935 | AAV70486.1 |
| 1053 | BORDETELLA PERTUSSIS | AKAPPAPKPAPQPGP | 1936 | ABO77783.1 |
| 1054 | BORDETELLA PERTUSSIS | APKPAPQPGP | 1937 | ABO77783.1 |
| 1055 | BORDETELLA PERTUSSIS | APKPAPQPGPQPPQP | 1938 | ABO77783.1 |
| 1056 | MEASLES VIRUS STRAIN EDMONSTON | AQTRTPLQCTMTEIF | 1939 | P04851.1 |
| 1057 | MEASLES VIRUS STRAIN EDMONSTON | ASRGTNMEDEADQYFSHDD | 1940 | P04851.1 |
| 1058 | BORDETELLA PERTUSSIS | ATIRR | 1941 | ABO77783.1 |
| 1059 | BORDETELLA PERTUSSIS | DNRAG | 1942 | ABO77783.1 |
| 1060 | BORDETELLA PERTUSSIS | EAPAPQPPAGRELSA | 1943 | ABO77783.1 |
| 1061 | MEASLES VIRUS STRAIN EDMONSTON | EMVRRSAGKVSSTLASELGI | 1944 | P04851.1 |
| 1062 | BORDETELLA PERTUSSIS | GASEL | 1945 | ABO77783.1 |
| 1063 | BORDETELLA PERTUSSIS | GDALAGGAVP | 1946 | AAA22980.1 |
| 1064 | BORDETELLA PERTUSSIS | GDAPAGGAVP | 1947 | ABO77783.1 |
| 1065 | BORDETELLA PERTUSSIS | GDTWDDD | 1948 | ABO77783.1 |
| 1066 | BORDETELLA PERTUSSIS | GERQH | 1949 | ABO77783.1 |
| 1067 | BORDETELLA PERTUSSIS | GGAVP | 1950 | ABO77783.1 |
| 1068 | BORDETELLA PERTUSSIS | GGFGP | 1951 | P14283.3 |
| 1069 | BORDETELLA PERTUSSIS | GGFGPGGFGP | 1952 | BAF35031.1 |
| 1070 | BORDETELLA PERTUSSIS | GGFGPVLDGW | 1953 | ABO77783.1 |
| 1071 | MEASLES VIRUS STRAIN EDMONSTON | GGKEDRRVKQSRGEARESYR | 1954 | P04851.1 |
| 1072 | BORDETELLA PERTUSSIS | GILLEN | 1955 | ABO77783.1 |
| 1073 | BORDETELLA PERTUSSIS | GIRRFL | 1956 | ABO77783.1 |

| NO. | DISEASE | EPITOPE AMINO ACID SEQUENCE | SEQ ID NO | ACCESS. NO. |
|---|---|---|---|---|
| 1074 | MEASLES VIRUS STRAIN EDMONSTON | HDDPISSDQSRFGWFENKEI | 1957 | P04851.1 |
| 1075 | MEASLES VIRUS STRAIN EDMONSTON | HEFAGELSTLESLMNLY | 1958 | P04851.1 |
| 1076 | BORDETELLA PERTUSSIS | HLGGLAGY | 1959 | ABO77783.1 |
| 1077 | MEASLES VIRUS STRAIN EDMONSTON | HTTEDKISRAVGPRQAQVSFL | 1960 | P04851.1 |
| 1078 | MEASLES VIRUS STRAIN EDMONSTON | ICDIDTYIVEAGLASFILTI | 1961 | P04851.1 |
| 1079 | MEASLES VIRUS STRAIN EDMONSTON | IIIVPIPGDSSITTRSLLD | 1962 | P04851.1 |
| 1080 | MEASLES VIRUS STRAIN EDMONSTON | ILDIKRTPGNKPRIAEMICD | 1963 | P04851.1 |
| 1081 | BORDETELLA PERTUSSIS | KALLYR | 1964 | ABO77783.1 |
| 1082 | MEASLES VIRUS STRAIN EDMONSTON | KPPITSGSGGAIRGIKHIII | 1965 | P04851.1 |
| 1083 | BORDETELLA PERTUSSIS | LAGSGL | 1966 | ABO77783.1 |
| 1084 | MEASLES VIRUS STRAIN EDMONSTON | LGITAEDARLVSEIAMHTTE | 1967 | P04851.1 |
| 1085 | MEASLES VIRUS STRAIN EDMONSTON | LGTILAQIWVLLAKAVTA | 1968 | P04851.1 |
| 1086 | MEASLES VIRUS STRAIN EDMONSTON | LPTGTPLDIDTASESSQD | 1969 | P04851.1 |
| 1087 | MEASLES VIRUS STRAIN EDMONSTON | MATLLRSLALFKRNKDK | 1970 | P04851.1 |
| 1088 | BORDETELLA PERTUSSIS | PAPQPP | 1971 | ABO77783.1 |
| 1089 | MEASLES VIRUS STRAIN EDMONSTON | PDTAADSELRRWIKYTQQRR | 1972 | P04851.1 |
| 1090 | MEASLES VIRUS STRAIN EDMONSTON | PKLTGALIGILSLFVESPGQ | 1973 | P04851.1 |
| 1091 | BORDETELLA PERTUSSIS | PQP | 1974 | ABO77783.1 |
| 1092 | BORDETELLA PERTUSSIS | PQPGP | 1975 | ABO77783.1 |
| 1093 | BORDETELLA PERTUSSIS | PQPGPQPPQPPQPQP | 1976 | ABO77783.1 |

| NO. | DISEASE | EPITOPE AMINO ACID SEQUENCE | SEQ ID NO | ACCESS. NO. |
|---|---|---|---|---|
| 1094 | MEASLES VIRUS STRAIN EDMONSTON | QDPQDSRRSAEPLLSCKPWQ | 1977 | P04851.1 |
| 1095 | MEASLES VIRUS STRAIN EDMONSTON | QRRVVGEFRLERKWLDVVR | 1978 | P04851.1 |
| 1096 | BORDETELLA PERTUSSIS | RELSA | 1979 | ABO77783.1 |
| 1097 | BORDETELLA PERTUSSIS | RFAPQ | 1980 | ABO77783.1 |
| 1098 | MEASLES VIRUS STRAIN EDMONSTON | SIQNKFSAGSYPLLWSYAMG | 1981 | P04851.1 |
| 1099 | BORDETELLA PERTUSSIS | SITLQAGAH | 1982 | ABO77783.1 |
| 1100 | BORDETELLA PERTUSSIS | SLQPED | 1983 | ABO77783.1 |
| 1101 | BORDETELLA PERTUSSIS | SNALSKRL | 1984 | ABO77783.1 |
| 1102 | MEASLES VIRUS STRAIN EDMONSTON | SPGQLIQRITDDPDVSIRLL | 1985 | P04851.1 |
| 1103 | BORDETELLA PERTUSSIS | TELPSIPG | 1986 | ABO77783.1 |
| 1104 | BORDETELLA PERTUSSIS | TFTLANK | 1987 | ABO77783.1 |
| 1105 | BORDETELLA PERTUSSIS | TWDDD | 1988 | ABO77783.1 |
| 1106 | MEASLES VIRUS STRAIN EDMONSTON | VSFLQGDQSENELPRLGGKE | 1989 | P04851.1 |
| 1107 | MEASLES VIRUS STRAIN EDMONSTON | WQESRKNKAQTRTPLQC | 1990 | P04851.1 |
| 1108 | MEASLES VIRUS STRAIN EDMONSTON | YAMGVGVELENSMGGLNFGR | 1991 | P04851.1 |
| 1109 | MEASLES VIRUS STRAIN EDMONSTON | YQQMGKPAPYMVNLENSI | 1992 | P04851.1 |
| 1110 | MEASLES VIRUS STRAIN HALLE | MTRSSHQSLVIKLMP | 1993 | P69355.1 |
| 1111 | MEASLES VIRUS STRAIN HALLE | PIRDALNAMTQNIRP | 1994 | P69355.1 |
| 1112 | RUBELLA VIRUS STRAIN M33 | ALLNTPPPYQVSCGGESDRASAGH | 1995 | CAA28880.1 |
| 1113 | RUBELLA VIRUS STRAIN THERIEN | GLGSPNCHGPDWASPVCQRHS | 1996 | P07566.1 |
| 1114 | RUBELLA VIRUS STRAIN THERIEN | GLGSPNCHGPDWASPVCQRHSPDCSRLV | 1997 | P07566.1 |
| 1115 | RUBELLA VIRUS STRAIN THERIEN | NYTGNQQSRWGLGSPNCHGPDWASPV | 1998 | P07566.1 |

-continued

| NO. | DISEASE | EPITOPE AMINO ACID SEQUENCE | SEQ ID NO | ACCESS. NO. |
|---|---|---|---|---|
| 1116 | RUBELLA VIRUS STRAIN THERIEN | TLPQPPCAHGQHYGHHHHQL | 1999 | P07566.1 |
| 1117 | RUBELLA VIRUS STRAIN THERIEN | TVRVKFHTETRTVWQLSVAGVSCNVT | 2000 | P07566.1 |
| 1118 | RUBELLA VIRUS | ASYFNPGGSYYKQYH | 2001 | BAA28178.1 |
| 1119 | RUBELLA VIRUS | FALASYVQHPHKTVR | 2002 | BAA28178.1 |
| 1120 | RUBELLA VIRUS | GGESDRASARVIDPAAQSFTG | 2003 | BAA28178.1 |
| 1121 | RUBELLA VIRUS | GPGEVWVTPVIGSQARKC | 2004 | BAA28178.1 |
| 1122 | RUBELLA VIRUS | GSQARKCGLHIRAG | 2005 | BAA28178.1 |
| 1123 | RUBELLA VIRUS | LVGATPERPRLRLVDADDPLLRTAP | 2006 | BAA28178.1 |
| 1124 | RUBELLA VIRUS | TAPGPGEVWVTPVI | 2007 | BAA28178.1 |
| 1125 | MEASLES MORBILLIVIRUS | FIVLSIAYPTLSEIK | 2008 | AAL29688.1 |
| 1126 | MEASLES VIRUS STRAIN EDMONSTON-ZAGREB | ETCFQQACKGKIQALCENPEWAPLK DNRIPSY | 2009 | P08362.1 |
| 1127 | MEASLES MORBILLIVIRUS | LPRLGGKEDR | 2010 | P04851.1 |
| 1128 | MEASLES MORBILLIVIRUS | MSKTEWNASQ | 2011 | SRC280080 |
| 1129 | MEASLES MORBILLIVIRUS | SRFGWFENKE | 2012 | P04851.1 |
| 1130 | RUBELLA VIRUS | EACVTSWLWSEGEGAVFYRVDLHFI NLGT | 2013 | CAA28880.1 |
| 1131 | RUBELLA VIRUS | MDFWCVEHDRPPPATPTSLTT | 2014 | CAA33016.1 |
| 1132 | RUBELLA VIRUS | PFLGHDGHHGGTLRVGQHHRNASDV | 2015 | CAA33016.1 |
| 1133 | RUBELLA VIRUS | RVKFHTETRTVWQLSVAGVSC | 2016 | BAA19893.1 |
| 1134 | MEASLES MORBILLIVIRUS | AEEQARHVKNGLE | 2017 | ABO69699.1 |
| 1135 | MEASLES MORBILLIVIRUS | ESPQEISKHQALG | 2018 | SRC280080 |
| 1136 | MEASLES MORBILLIVIRUS | GVGVELENSMGGLNF | 2019 | ABI54110.1 |
| 1137 | MEASLES MORBILLIVIRUS | IKGANDLAKFHQMLMKIIMK | 2020 | ABO69699.1 |
| 1138 | MEASLES MORBILLIVIRUS | MSKTLHAQLGFKKT | 2021 | ABK40528.1 |
| 1139 | MEASLES MORBILLIVIRUS | NASGLSRPSPSAH | 2022 | BAE98296.1 |
| 1140 | MEASLES MORBILLIVIRUS | VRVIDPSLGDRKDE | 2023 | SRC280148 |
| 1141 | BORDETELLA PERTUSSIS | DLSDGDLLV | 2024 | AAC31207.1 |
| 1142 | BORDETELLA PERTUSSIS | EAERAGRGTG | 2025 | ACI04548.1 |
| 1143 | BORDETELLA PERTUSSIS | YRYDSRPPEDV | 2026 | ACI04548.1 |

| NO. | DISEASE | EPITOPE AMINO ACID SEQUENCE | SEQ ID NO | ACCESS. NO. |
|---|---|---|---|---|
| 1144 | BORDETELLA PERTUSSIS | YVDTYGDNAG | 2027 | ACI04548.1 |
| 1145 | MEASLES MORBILLIVIRUS | SFSYFYPFR | 2028 | CAB43772.1 |
| 1146 | MUMPS RUBULAVIRUS | DIFIVSPR | 2029 | ADF49557

-continued

| NO. | DISEASE | EPITOPE AMINO ACID SEQUENCE | SEQ ID NO | ACCESS. NO. |
|---|---|---|---|---|
| 1169 | BORDETELLA PERTUSSIS | DANGVLKHSI | 2052 | P15318.2 |
| 1170 | BORDETELLA PERTUSSIS | DGDMNIGVI | 2053 | P15318.2 |
| 1171 | BORDETELLA PERTUSSIS | DHVKNIENL | 2054 | P15318.2 |
| 1172 | BORDETELLA PERTUSSIS | DIDMFAIM | 2055 | P15318.2 |
| 1173 | BORDETELLA PERTUSSIS | DMFAIMPHL | 2056 | P15318.2 |
| 1174 | BORDETELLA PERTUSSIS | DNVRNVENV | 2057 | P15318.2 |
| 1175 | BORDETELLA PERTUSSIS | DNVRNVENVI | 2058 | P15318.2 |
| 1176 | BORDETELLA PERTUSSIS | DTVDYSAM | 2059 | P15318.2 |
| 1177 | BORDETELLA PERTUSSIS | DTVDYSAMI | 2060 | P15318.2 |
| 1178 | BORDETELLA PERTUSSIS | DYLRQAGL | 2061 | P15318.2 |
| 1179 | BORDETELLA PERTUSSIS | DYYDNVRNV | 2062 | P15318.2 |
| 1180 | BORDETELLA PERTUSSIS | EFTTFVEI | 2063 | P15318.2 |
| 1181 | BORDETELLA PERTUSSIS | EFTTFVEIV | 2064 | P15318.2 |
| 1182 | BORDETELLA PERTUSSIS | EGYVFYEN | 2065 | P15318.2 |
| 1183 | BORDETELLA PERTUSSIS | ENVQYRHV | 2066 | P15318.2 |
| 1184 | BORDETELLA PERTUSSIS | EQLANSDGL | 2067 | P15318.2 |
| 1185 | BORDETELLA PERTUSSIS | FGVGYGHDTI | 2068 | P15318.2 |
| 1186 | BORDETELLA PERTUSSIS | FSPDVLETVP | 2069 | P15318.2 |
| 1187 | BORDETELLA PERTUSSIS | FSVDHVKNI | 2070 | P15318.2 |
| 1188 | BORDETELLA PERTUSSIS | GDDTYLFGV | 2071 | P15318.2 |
| 1189 | BORDETELLA PERTUSSIS | GDDVFLQDL | 2072 | P15318.2 |
| 1190 | BORDETELLA PERTUSSIS | GEDGNDIFL | 2073 | P15318.2 |
| 1191 | BORDETELLA PERTUSSIS | GERFNVRKQL | 2074 | P15318.2 |
| 1192 | BORDETELLA PERTUSSIS | GGAGNDTLV | 2075 | P15318.2 |
| 1193 | BORDETELLA PERTUSSIS | GGDDFEAV | 2076 | P15318.2 |

-continued

| NO. | DISEASE | EPITOPE AMINO ACID SEQUENCE | SEQ ID NO | ACCESS. NO. |
|---|---|---|---|---|
| 1194 | BORDETELLA PERTUSSIS | GKSEFTTFV | 2077 | P15318.2 |
| 1195 | BORDETELLA PERTUSSIS | GKSLFDDGL | 2078 | P15318.2 |
| 1196 | BORDETELLA PERTUSSIS | GNADNLKSV | 2079 | P15318.2 |
| 1197 | BORDETELLA PERTUSSIS | GQLVEVDTL | 2080 | P15318.2 |
| 1198 | BORDETELLA PERTUSSIS | GRSKFSPDV | 2081 | P15318.2 |
| 1199 | BORDETELLA PERTUSSIS | GSSAYDTV | 2082 | P15318.2 |
| 1200 | BORDETELLA PERTUSSIS | GTVEKWPAL | 2083 | P15318.2 |
| 1201 | BORDETELLA PERTUSSIS | GVDYYDNV | 2084 | P15318.2 |
| 1202 | BORDETELLA PERTUSSIS | GYEQFEFRV | 2085 | P15318.2 |
| 1203 | BORDETELLA PERTUSSIS | HAVGAQDVV | 2086 | P15318.2 |
| 1204 | BORDETELLA PERTUSSIS | IAAGRIGLGI | 2087 | P15318.2 |
| 1205 | BORDETELLA PERTUSSIS | IGDAQANTL | 2088 | P15318.2 |
| 1206 | BORDETELLA PERTUSSIS | IGLGILADL | 2089 | P15318.2 |
| 1207 | BORDETELLA PERTUSSIS | IGNAAGIPL | 2090 | P15318.2 |
| 1208 | BORDETELLA PERTUSSIS | IGTSMKDVL | 2091 | P15318.2 |
| 1209 | BORDETELLA PERTUSSIS | IGVITDFEL | 2092 | P15318.2 |
| 1210 | BORDETELLA PERTUSSIS | IPLTADIDM | 2093 | P15318.2 |
| 1211 | BORDETELLA PERTUSSIS | ISKSALEL | 2094 | P15318.2 |
| 1212 | BORDETELLA PERTUSSIS | ITGNADNL | 2095 | P15318.2 |
| 1213 | BORDETELLA PERTUSSIS | KIFVVSAT | 2096 | P15318.2 |
| 1214 | BORDETELLA PERTUSSIS | KQLNNANVYR | 2097 | P15318.2 |
| 1215 | BORDETELLA PERTUSSIS | KVIGNAAGI | 2098 | P15318.2 |
| 1216 | BORDETELLA PERTUSSIS | LAKVVSQL | 2099 | P15318.2 |
| 1217 | BORDETELLA PERTUSSIS | LANDYARKI | 2100 | P15318.2 |
| 1218 | BORDETELLA PERTUSSIS | LDYLRQAGL | 2101 | P15318.2 |

-continued

| NO. | DISEASE | EPITOPE AMINO ACID SEQUENCE | SEQ ID NO | ACCESS. NO. |
|---|---|---|---|---|
| 1219 | BORDETELLA PERTUSSIS | LGKGFASL | 2102 | P15318.2 |
| 1220 | BORDETELLA PERTUSSIS | LGKGFASLM | 2103 | P15318.2 |
| 1221 | BORDETELLA PERTUSSIS | LGVDYYDN | 2104 | P15318.2 |
| 1222 | BORDETELLA PERTUSSIS | LGVDYYDNV | 2105 | P15318.2 |
| 1223 | BORDETELLA PERTUSSIS | LKHSIKLDVI | 2106 | P15318.2 |
| 1224 | BORDETELLA PERTUSSIS | LQAGYIPV | 2107 | P15318.2 |
| 1225 | BORDETELLA PERTUSSIS | LQLTGGTVE | 2108 | P15318.2 |
| 1226 | BORDETELLA PERTUSSIS | LSAAVFGL | 2109 | P15318.2 |
| 1227 | BORDETELLA PERTUSSIS | LSLGKGFASL | 2110 | P15318.2 |
| 1228 | BORDETELLA PERTUSSIS | LSPMEIYGL | 2111 | P15318.2 |
| 1229 | BORDETELLA PERTUSSIS | NAHDNFLAGG | 2112 | P15318.2 |
| 1230 | BORDETELLA PERTUSSIS | NANVYREGV | 2113 | P15318.2 |
| 1231 | BORDETELLA PERTUSSIS | NDTLYGGL | 2114 | P15318.2 |
| 1232 | BORDETELLA PERTUSSIS | NGLAGNDVL | 2115 | P15318.2 |
| 1233 | BORDETELLA PERTUSSIS | NNANVYREGV | 2116 | P15318.2 |
| 1234 | BORDETELLA PERTUSSIS | NTVSYAAL | 2117 | P15318.2 |
| 1235 | BORDETELLA PERTUSSIS | NVLRNIENAV | 2118 | P15318.2 |
| 1236 | BORDETELLA PERTUSSIS | PALTFITPL | 2119 | P15318.2 |
| 1237 | BORDETELLA PERTUSSIS | PETSNVLRNI | 2120 | P15318.2 |
| 1238 | BORDETELLA PERTUSSIS | PMEIYGLV | 2121 | P15318.2 |
| 1239 | BORDETELLA PERTUSSIS | PQAYFEKNL | 2122 | P15318.2 |
| 1240 | BORDETELLA PERTUSSIS | PVNPNLSKL | 2123 | P15318.2 |
| 1241 | BORDETELLA PERTUSSIS | QAGWNASSV | 2124 | P15318.2 |
| 1242 | BORDETELLA PERTUSSIS | QAGWNASSVI | 2125 | P15318.2 |
| 1243 | BORDETELLA PERTUSSIS | QDAANAGNL | 2126 | P15318.2 |

-continued

| NO. | DISEASE | EPITOPE AMINO ACID SEQUENCE | SEQ ID NO | ACCESS. NO. |
|---|---|---|---|---|
| 1244 | BORDETELLA PERTUSSIS | QDAANAGNLL | 2127 | P15318.2 |
| 1245 | BORDETELLA PERTUSSIS | QDSGYDSL | 2128 | P15318.2 |
| 1246 | BORDETELLA PERTUSSIS | QQSHYADQL | 2129 | P15318.2 |
| 1247 | BORDETELLA PERTUSSIS | RALQGAQAV | 2130 | P15318.2 |
| 1248 | BORDETELLA PERTUSSIS | RGGLGLDTL | 2131 | P15318.2 |
| 1249 | BORDETELLA PERTUSSIS | RKQLNNANV | 2132 | P15318.2 |
| 1250 | BORDETELLA PERTUSSIS | RQDSGYDSL | 2133 | P15318.2 |
| 1251 | BORDETELLA PERTUSSIS | RQFRYDGDM | 2134 | P15318.2 |
| 1252 | BORDETELLA PERTUSSIS | RSKFSPDVL | 2135 | P15318.2 |
| 1253 | BORDETELLA PERTUSSIS | SAGAAAGAL | 2136 | P15318.2 |
| 1254 | BORDETELLA PERTUSSIS | SAHWGQRAL | 2137 | P15318.2 |
| 1255 | BORDETELLA PERTUSSIS | SAMIHPGRI | 2138 | P15318.2 |
| 1256 | BORDETELLA PERTUSSIS | SAMIHPGRIV | 2139 | P15318.2 |
| 1257 | BORDETELLA PERTUSSIS | SAYDTVSGI | 2140 | P15318.2 |
| 1258 | BORDETELLA PERTUSSIS | SAYGYEGD | 2141 | P15318.2 |
| 1259 | BORDETELLA PERTUSSIS | SGGAGDDVL | 2142 | P15318.2 |
| 1260 | BORDETELLA PERTUSSIS | SGLQVAGA | 2143 | P15318.2 |
| 1261 | BORDETELLA PERTUSSIS | SGYDSLDGV | 2144 | P15318.2 |
| 1262 | BORDETELLA PERTUSSIS | SLLTGALNGI | 2145 | P15318.2 |
| 1263 | BORDETELLA PERTUSSIS | SPMEIYGL | 2146 | P15318.2 |
| 1264 | BORDETELLA PERTUSSIS | SQMLTRGQL | 2147 | P15318.2 |
| 1265 | BORDETELLA PERTUSSIS | SSAYDTVSGI | 2148 | P15318.2 |
| 1266 | BORDETELLA PERTUSSIS | SSLAHGHTA | 2149 | P15318.2 |
| 1267 | BORDETELLA PERTUSSIS | SSVTSGDSV | 2150 | P15318.2 |
| 1268 | BORDETELLA PERTUSSIS | SVIGVQTTEI | 2151 | P15318.2 |

-continued

| NO. | DISEASE | EPITOPE AMINO ACID SEQUENCE | SEQ ID NO | ACCESS. NO. |
|---|---|---|---|---|
| 1269 | BORDETELLA PERTUSSIS | TNTVSYAAL | 2152 | P15318.2 |
| 1270 | BORDETELLA PERTUSSIS | TSLIAEGV | 2153 | P15318.2 |
| 1271 | BORDETELLA PERTUSSIS | TSLLTGAL | 2154 | P15318.2 |
| 1272 | BORDETELLA PERTUSSIS | TVPASPGL | 2155 | P15318.2 |
| 1273 | BORDETELLA PERTUSSIS | VAKEKNATL | 2156 | P15318.2 |
| 1274 | BORDETELLA PERTUSSIS | VAPHEYGFGI | 2157 | P15318.2 |
| 1275 | BORDETELLA PERTUSSIS | VAVVTSLL | 2158 | P15318.2 |
| 1276 | BORDETELLA PERTUSSIS | VFYENRAYG | 2159 | P15318.2 |
| 1277 | BORDETELLA PERTUSSIS | VFYENRAYGV | 2160 | P15318.2 |
| 1278 | BORDETELLA PERTUSSIS | VITDFELEV | 2161 | P15318.2 |
| 1279 | BORDETELLA PERTUSSIS | VNPHSTSL | 2162 | P15318.2 |
| 1280 | BORDETELLA PERTUSSIS | VNPHSTSLI | 2163 | P15318.2 |
| 1281 | BORDETELLA PERTUSSIS | VNPNLSKL | 2164 | P15318.2 |
| 1282 | BORDETELLA PERTUSSIS | VNPNLSKLF | 2165 | P15318.2 |
| 1283 | BORDETELLA PERTUSSIS | VQQPIIEKL | 2166 | P15318.2 |
| 1284 | BORDETELLA PERTUSSIS | VQYRHVEL | 2167 | P15318.2 |
| 1285 | BORDETELLA PERTUSSIS | VSIAAAASV | 2168 | P15318.2 |
| 1286 | BORDETELLA PERTUSSIS | VSIAAAASVV | 2169 | P15318.2 |
| 1287 | BORDETELLA PERTUSSIS | VTSLLTGAL | 2170 | P15318.2 |
| 1288 | BORDETELLA PERTUSSIS | VVLANASRI | 2171 | P15318.2 |
| 1289 | BORDETELLA PERTUSSIS | WPALNLFSV | 2172 | P15318.2 |
| 1290 | BORDETELLA PERTUSSIS | WVRKASAL | 2173 | P15318.2 |
| 1291 | BORDETELLA PERTUSSIS | YAVQYRRKGG | 2174 | P15318.2 |
| 1292 | BORDETELLA PERTUSSIS | YGGLGDDTL | 2175 | P15318.2 |
| 1293 | BORDETELLA PERTUSSIS | YGLVQQSHYA | 2176 | P15318.2 |

-continued

| NO. | DISEASE | EPITOPE AMINO ACID SEQUENCE | SEQ ID NO | ACCESS. NO. |
|---|---|---|---|---|
| 1294 | BORDETELLA PERTUSSIS | YGYEGDALL | 2177 | P15318.2 |
| 1295 | BORDETELLA PERTUSSIS | YIPVNPNL | 2178 | P15318.2 |
| 1296 | BORDETELLA PERTUSSIS | YSAMIHPGRI | 2179 | P15318.2 |
| 1297 | BORDETELLA PERTUSSIS | YSQTGAHAGI | 2180 | P15318.2 |
| 1298 | CORYNEBACTERIUM DIPHTHERIAE | AYNFVESIINLFQVVHNSYN | 2181 | CAE11230.1 |
| 1299 | BORDETELLA PERTUSSIS | SGTTIK | 2182 | BAF35031.1 |
| 1300 | BORDETELLA PERTUSSIS | RGHTLESAEGRKIFG | 2183 | AAA22974.1 |
| 1301 | BORDETELLA PERTUSSIS | AGAMTVRDVAAAADLALQAGDA | 2184 | AAA22974.1 |
| 1302 | BORDETELLA PERTUSSIS | AGAMTVRDVAAAADLALQAGDAL | 2185 | AAA22974.1 |
| 1303 | BORDETELLA PERTUSSIS | ALAAVLVNPHIFTRIGAAQTSLADGAAGPA | 2186 | AAA22974.1 |
| 1304 | BORDETELLA PERTUSSIS | ALSIDSMTALGA | 2187 | AAA22974.1 |
| 1305 | BORDETELLA PERTUSSIS | DLSAARGADISGEGR | 2188 | AAA22974.1 |
| 1306 | BORDETELLA PERTUSSIS | DQNRYEYIWGLY | 2189 | AAA22974.1 |
| 1307 | BORDETELLA PERTUSSIS | DYTVSADAIALA | 2190 | AAA22974.1 |
| 1308 | BORDETELLA PERTUSSIS | GPIVVEAGELVSHAGG | 2191 | AAA22974.1 |
| 1309 | BORDETELLA PERTUSSIS | GRPEGLKIGAHSATSVSGSFDAL | 2192 | AAA22974.1 |
| 1310 | BORDETELLA PERTUSSIS | ITVTSRGGFDNEGKMESNK | 2193 | AAA22974.1 |
| 1311 | BORDETELLA PERTUSSIS | LDQNRYEYIWGLYP | 2194 | AAA22974.1 |
| 1312 | BORDETELLA PERTUSSIS | LSAARGADISG | 2195 | AAA22974.1 |
| 1313 | BORDETELLA PERTUSSIS | NKIRLMGPLQ | 2196 | AAA22974.1 |
| 1314 | BORDETELLA PERTUSSIS | NKLGRIRAGEDM | 2197 | AAA22974.1 |
| 1315 | BORDETELLA PERTUSSIS | NKLGRIRAGEDMHLDAPRIE | 2198 | AAA22974.1 |
| 1316 | BORDETELLA PERTUSSIS | PHLRNTGQVVAG | 2199 | AAA22974.1 |
| 1317 | BORDETELLA PERTUSSIS | QVDLHDLSAARGADISG | 2200 | AAA22974.1 |
| 1318 | BORDETELLA PERTUSSIS | RDVAAAADLALQ | 2201 | AAA22974.1 |

| NO. | DISEASE | EPITOPE AMINO ACID SEQUENCE | SEQ ID NO | ACCESS. NO. |
|---|---|---|---|---|
| 1319 | BORDETELLA PERTUSSIS | SAARGADISGEG | 2202 | AAA22974.1 |
| 1320 | BORDETELLA PERTUSSIS | TKGEMQIAGKGGGSP | 2203 | AAA22974.1 |
| 1321 | BORDETELLA PERTUSSIS | TVSADAIALAAQ | 2204 | AAA22974.1 |
| 1322 | BORDETELLA PERTUSSIS | VVAGHDIHI | 2205 | AAA22974.1 |
| 1323 | BORDETELLA PERTUSSIS | PSGPNHTKVVQLPKISKNALKANG | 2206 | CAD12823.1 |
| 1324 | RUBELLA VIRUS | LVGATPERPRLRLVDADDPLLRTAPG PGEVWVTPVIGSQAR | 2207 | BAA19902.1 |
| 1325 | RUBELLA VIRUS | QQSRWGLGSPNCHGPDWASPVCQRH SP | 2208 | BAA19902.1 |
| 1326 | BORDETELLA PERTUSSIS | AGEAMVLVYYESIAYSF | 2209 | ACI04548.1 |
| 1327 | BORDETELLA PERTUSSIS | GGVGLASTLWYAESNALSKRLGEL | 2210 | AAZ74322.1 |
| 1328 | BORDETELLA PERTUSSIS | GTLVRIAPVIGACMARQA | 2211 | ACI04548.1 |
| 1329 | BORDETELLA PERTUSSIS | IRRVTRVYHNGITGETTT | 2212 | ACI04548.1 |
| 1330 | BORDETELLA PERTUSSIS | IVKTGERQHGIHIQGSDP | 2213 | AAZ74322.1 |
| 1331 | BORDETELLA PERTUSSIS | IVKTGERQHGIHIQGSDPGGVRTA | 2214 | AAZ74338.1 |
| 1332 | BORDETELLA PERTUSSIS | LRDTNVTAVPASGAPAAVSVLGAS | 2215 | AAZ74338.1 |
| 1333 | BORDETELLA PERTUSSIS | PEAPAPQPPAGRELSAAANAAVNT | 2216 | AAZ74322.1 |
| 1334 | BORDETELLA PERTUSSIS | AAADFAHAE | 2217 | WP_019247158.1 |
| 1335 | BORDETELLA PERTUSSIS | AAAEVAGAL | 2218 | WP_019249248.1 |
| 1336 | BORDETELLA PERTUSSIS | AAESTFESY | 2219 | WP_019247158.1 |
| 1337 | BORDETELLA PERTUSSIS | AAGFDPEVQ | 2220 | WP_019248145.1 |
| 1338 | BORDETELLA PERTUSSIS | AALGRGHSL | 2221 | AGS56996.1 |
| 1339 | BORDETELLA PERTUSSIS | AAMQGAVVH | 2222 | AGT50936.1 |
| 1340 | BORDETELLA PERTUSSIS | AAPAAHADW | 2223 | AGS56996.1 |
| 1341 | BORDETELLA PERTUSSIS | AAQATVVQR | 2224 | WP_019247158.1 |
| 1342 | BORDETELLA PERTUSSIS | AARVAGDNY | 2225 | WP_019249248.1 |
| 1343 | BORDETELLA PERTUSSIS | AAVALLNKL | 2226 | WP_019249248.1 |

-continued

| NO. | DISEASE | EPITOPE AMINO ACID SEQUENCE | SEQ ID NO | ACCESS. NO. |
|---|---|---|---|---|
| 1344 | BORDETELLA PERTUSSIS | ADDPPATVY | 2227 | AAW72734.1 |
| 1345 | BORDETELLA PERTUSSIS | AEAGRFKVL | 2228 | AGS56996.1 |
| 1346 | BORDETELLA PERTUSSIS | AEATQLVTA | 2229 | WP_019247158.1 |
| 1347 | BORDETELLA PERTUSSIS | AEGGATLGA | 2230 | WP_019249248.1 |
| 1348 | BORDETELLA PERTUSSIS | AEHGEVSIQ | 2231 | WP_019249248.1 |
| 1349 | BORDETELLA PERTUSSIS | AEIAFYPKE | 2232 | WP_019249248.1 |
| 1350 | BORDETELLA PERTUSSIS | AEKVTTPAV | 2233 | WP_019247158.1 |
| 1351 | BORDETELLA PERTUSSIS | AELQTYLRQ | 2234 | 1BCP_C |
| 1352 | BORDETELLA PERTUSSIS | AEQSLIEVG | 2235 | WP_019249248.1 |
| 1353 | BORDETELLA PERTUSSIS | AESNALSKR | 2236 | AGS56996.1 |
| 1354 | BORDETELLA PERTUSSIS | AESSEAMAA | 2237 | AFK26302.1 |
| 1355 | BORDETELLA PERTUSSIS | AEVKVGYRA | 2238 | WP_019247158.1 |
| 1356 | BORDETELLA PERTUSSIS | AEVTDTSPS | 2239 | WP_019249248.1 |
| 1357 | BORDETELLA PERTUSSIS | AGKSLKKKN | 2240 | WP_019247158.1 |
| 1358 | BORDETELLA PERTUSSIS | AGLAGPSAV | 2241 | WP_019249248.1 |
| 1359 | BORDETELLA PERTUSSIS | AIRVGRGAR | 2242 | AGT50936.1 |
| 1360 | BORDETELLA PERTUSSIS | ALAAIASAA | 2243 | WP_019248145.1 |
| 1361 | BORDETELLA PERTUSSIS | ALADVPYVL | 2244 | AAA22983.1 |
| 1362 | BORDETELLA PERTUSSIS | ALANDGTIV | 2245 | WP_019248658.1 |
| 1363 | BORDETELLA PERTUSSIS | ALGRGHSLY | 2246 | AGS56996.1 |
| 1364 | BORDETELLA PERTUSSIS | ALILAASPV | 2247 | WP_019248658.1 |
| 1365 | BORDETELLA PERTUSSIS | ALMLACTGL | 2248 | AAA22974.1 |
| 1366 | BORDETELLA PERTUSSIS | AMQGAVVHL | 2249 | AGT50936.1 |
| 1367 | BORDETELLA PERTUSSIS | AMTHLSPAL | 2250 | AAA22983.1 |
| 1368 | BORDETELLA PERTUSSIS | AMYGKHITL | 2251 | WP_019249248.1 |

-continued

| NO. | DISEASE | EPITOPE AMINO ACID SEQUENCE | SEQ ID NO | ACCESS. NO. |
| --- | --- | --- | --- | --- |
| 1369 | BORDETELLA PERTUSSIS | ANEANALLW | 2252 | WP_019249248.1 |
| 1370 | BORDETELLA PERTUSSIS | APLSITLQA | 2253 | AGT50936.1 |
| 1371 | BORDETELLA PERTUSSIS | APNALAWAL | 2254 | AAA22974.1 |
| 1372 | BORDETELLA PERTUSSIS | APPAPKPAP | 2255 | AGS56996.1 |
| 1373 | BORDETELLA PERTUSSIS | APPGAGFIY | 2256 | 1BCP_C |
| 1374 | BORDETELLA PERTUSSIS | APQAAPLSI | 2257 | AGT50936.1 |
| 1375 | BORDETELLA PERTUSSIS | APRIENTAK | 2258 | WP_019249248.1 |
| 1376 | BORDETELLA PERTUSSIS | AQGKALLYR | 2259 | AGT50936.1 |
| 1377 | BORDETELLA PERTUSSIS | AQITSYVGF | 2260 | WP_019248658.1 |
| 1378 | BORDETELLA PERTUSSIS | AQLEVRGQR | 2261 | WP_019249248.1 |
| 1379 | BORDETELLA PERTUSSIS | AQQLKQADR | 2262 | WP_019247699.1 |
| 1380 | BORDETELLA PERTUSSIS | AQVTVAGRY | 2263 | WP_019249248.1 |
| 1381 | BORDETELLA PERTUSSIS | ARRSRVRAL | 2264 | NP_882284.1 |
| 1382 | BORDETELLA PERTUSSIS | ASPRRARRA | 2265 | WP_019249248.1 |
| 1383 | BORDETELLA PERTUSSIS | ASSPDAHVP | 2266 | AAA22983.1 |
| 1384 | BORDETELLA PERTUSSIS | ASVSNPGTF | 2267 | WP_019249248.1 |
| 1385 | BORDETELLA PERTUSSIS | ATWNFQSTY | 2268 | WP_019249248.1 |
| 1386 | BORDETELLA PERTUSSIS | ATYIADSGF | 2269 | AGS56996.1 |
| 1387 | BORDETELLA PERTUSSIS | AVAAPAVGA | 2270 | WP_019249248.1 |
| 1388 | BORDETELLA PERTUSSIS | AVFMQQRPL | 2271 | AAA22983.1 |
| 1389 | BORDETELLA PERTUSSIS | AVLVNPHIF | 2272 | WP_019249248.1 |
| 1390 | BORDETELLA PERTUSSIS | CFGKDLKRP | 2273 | AAA22983.1 |
| 1391 | BORDETELLA PERTUSSIS | CPSSLGNGV | 2274 | WP_019248145.1 |
| 1392 | BORDETELLA PERTUSSIS | DAGHEHDTW | 2275 | AAA22984.1 |
| 1393 | BORDETELLA PERTUSSIS | DAKHDLTVT | 2276 | WP_019249248.1 |

-continued

| NO. | DISEASE | EPITOPE AMINO ACID SEQUENCE | SEQ ID NO | ACCESS. NO. |
| --- | --- | --- | --- | --- |
| 1394 | BORDETELLA PERTUSSIS | DASGQHRLW | 2277 | AGS56996.1 |
| 1395 | BORDETELLA PERTUSSIS | DATFETYAL | 2278 | YP_006628018.1 |
| 1396 | BORDETELLA PERTUSSIS | DATFQTYAL | 2279 | 1BCP_C |
| 1397 | BORDETELLA PERTUSSIS | DATLVGAKF | 2280 | WP_019247158.1 |
| 1398 | BORDETELLA PERTUSSIS | DDEVDVSGR | 2281 | AAA22974.1 |
| 1399 | BORDETELLA PERTUSSIS | DENGKPQTY | 2282 | WP_019247158.1 |
| 1400 | BORDETELLA PERTUSSIS | DGPPSRPTT | 2283 | WP_019247158.1 |
| 1401 | BORDETELLA PERTUSSIS | DHLTGRSCQ | 2284 | AAW72734.1 |
| 1402 | BORDETELLA PERTUSSIS | DNEGKMESN | 2285 | WP_019249248.1 |
| 1403 | BORDETELLA PERTUSSIS | DPPATVYRY | 2286 | AAW72734.1 |
| 1404 | BORDETELLA PERTUSSIS | EATEGDATL | 2287 | WP_019247158.1 |
| 1405 | BORDETELLA PERTUSSIS | EATQQAAGF | 2288 | WP_019248145.1 |
| 1406 | BORDETELLA PERTUSSIS | ECSGKQDCP | 2289 | AAA22983.1 |
| 1407 | BORDETELLA PERTUSSIS | EGGKLRGKD | 2290 | AAA22974.1 |
| 1408 | BORDETELLA PERTUSSIS | EGKMESNKD | 2291 | WP_019249248.1 |
| 1409 | BORDETELLA PERTUSSIS | EHRMQEAVE | 2292 | AAW72734.1 |
| 1410 | BORDETELLA PERTUSSIS | EKRLDIDDA | 2293 | WP_019249248.1 |
| 1411 | BORDETELLA PERTUSSIS | EPASANTLL | 2294 | AGS56996.1 |
| 1412 | BORDETELLA PERTUSSIS | EPQAELAVF | 2295 | AGS56996.1 |
| 1413 | BORDETELLA PERTUSSIS | EPVKLTLTG | 2296 | AGT50936.1 |
| 1414 | BORDETELLA PERTUSSIS | ESAEGRKIF | 2297 | WP_019249248.1 |
| 1415 | BORDETELLA PERTUSSIS | ESYSESHNF | 2298 | WP_019247158.1 |
| 1416 | BORDETELLA PERTUSSIS | ETFCITTIY | 2299 | 1BCP_C |
| 1417 | BORDETELLA PERTUSSIS | EVAGALELS | 2300 | WP_019249248.1 |
| 1418 | BORDETELLA PERTUSSIS | EVAKVEVVP | 2301 | WP_019247158.1 |

-continued

| NO. | DISEASE | EPITOPE AMINO ACID SEQUENCE | SEQ ID NO | ACCESS. NO. |
|---|---|---|---|---|
| 1419 | BORDETELLA PERTUSSIS | EVDGIIQEF | 2302 | WP_019249248.1 |
| 1420 | BORDETELLA PERTUSSIS | EVRADNNFY | 2303 | WP_019248344.1 |
| 1421 | BORDETELLA PERTUSSIS | FAILSSTTE | 2304 | WP_019247158.1 |
| 1422 | BORDETELLA PERTUSSIS | FAISAYALK | 2305 | AAA22984.1 |
| 1423 | BORDETELLA PERTUSSIS | FALYDGTYL | 2306 | AFK26303.1 |
| 1424 | BORDETELLA PERTUSSIS | FDTMLGFAI | 2307 | AAA22984.1 |
| 1425 | BORDETELLA PERTUSSIS | FEGKPALEL | 2308 | AAA22983.1 |
| 1426 | BORDETELLA PERTUSSIS | FELGADHAV | 2309 | AGS56996.1 |
| 1427 | BORDETELLA PERTUSSIS | FEPGITTNY | 2310 | WP_019248658.1 |
| 1428 | BORDETELLA PERTUSSIS | FETYALTGI | 2311 | YP_006628018.1 |
| 1429 | BORDETELLA PERTUSSIS | FIYRETFCI | 2312 | 1BCP_C |
| 1430 | BORDETELLA PERTUSSIS | FPTRTTAPG | 2313 | NP_882284.1 |
| 1431 | BORDETELLA PERTUSSIS | FQTYALTGI | 2314 | 1BCP_C |
| 1432 | BORDETELLA PERTUSSIS | FTHADGWFL | 2315 | AGS56996.1 |
| 1433 | BORDETELLA PERTUSSIS | FVRDGQSVI | 2316 | 1BCP_C |
| 1434 | BORDETELLA PERTUSSIS | FVRSGQPVI | 2317 | YP_006628018.1 |
| 1435 | BORDETELLA PERTUSSIS | FVWYVDTVI | 2318 | WP_019248866.1 |
| 1436 | BORDETELLA PERTUSSIS | GAASSRQAL | 2319 | WP_019249248.1 |
| 1437 | BORDETELLA PERTUSSIS | GAASSYFEY | 2320 | AAW72734.1 |
| 1438 | BORDETELLA PERTUSSIS | GAFDLKTTF | 2321 | AFK26303.1 |
| 1439 | BORDETELLA PERTUSSIS | GAPAAVSVL | 2322 | AGS56996.1 |
| 1440 | BORDETELLA PERTUSSIS | GATRAVDSL | 2323 | AGS56996.1 |
| 1441 | BORDETELLA PERTUSSIS | GAVPGGAVP | 2324 | AGT50936.1 |
| 1442 | BORDETELLA PERTUSSIS | GEAMVLVYY | 2325 | AFK26302.1 |
| 1443 | BORDETELLA PERTUSSIS | GEIALGDAT | 2326 | WP_019249248.1 |

| NO. | DISEASE | EPITOPE AMINO ACID SEQUENCE | SEQ ID NO | ACCESS. NO. |
|---|---|---|---|---|
| 1444 | BORDETELLA PERTUSSIS | GELMAAQVA | 2327 | WP_019247158.1 |
| 1445 | BORDETELLA PERTUSSIS | GGVPGGAVP | 2328 | AAZ74338.1 |
| 1446 | BORDETELLA PERTUSSIS | GHEHDTWFD | 2329 | AAA22984.1 |
| 1447 | BORDETELLA PERTUSSIS | GIGALKAGA | 2330 | WP_019249248.1 |
| 1448 | BORDETELLA PERTUSSIS | GIVIPPKAL | 2331 | 1BCP_C |
| 1449 | BORDETELLA PERTUSSIS | GKDLKRPGS | 2332 | AAA22983.1 |
| 1450 | BORDETELLA PERTUSSIS | GKLPKPVTV | 2333 | WP_019247158.1 |
| 1451 | BORDETELLA PERTUSSIS | GKSLKKKNQ | 2334 | WP_019247158.1 |
| 1452 | BORDETELLA PERTUSSIS | GLDVQQGTV | 2335 | WP_019249248.1 |
| 1453 | BORDETELLA PERTUSSIS | GLTDGVSRI | 2336 | WP_019249248.1 |
| 1454 | BORDETELLA PERTUSSIS | GLYPTYTEW | 2337 | WP_019249248.1 |
| 1455 | BORDETELLA PERTUSSIS | GLYQTYTEW | 2338 | YP_006626470.1 |
| 1456 | BORDETELLA PERTUSSIS | GPPSRPTTP | 2339 | WP_019247158.1 |
| 1457 | BORDETELLA PERTUSSIS | GPSAVAAPA | 2340 | WP_019249248.1 |
| 1458 | BORDETELLA PERTUSSIS | GVAPTAQQL | 2341 | WP_019248866.1 |
| 1459 | BORDETELLA PERTUSSIS | GVGLASTLW | 2342 | AGS56996.1 |
| 1460 | BORDETELLA PERTUSSIS | GYEAGFSLG | 2343 | WP_019247158.1 |
| 1461 | BORDETELLA PERTUSSIS | HADDGTIVI | 2344 | WP_019248145.1 |
| 1462 | BORDETELLA PERTUSSIS | HADWNNQSI | 2345 | AGS56996.1 |
| 1463 | BORDETELLA PERTUSSIS | HAEHEKDVR | 2346 | WP_019247158.1 |
| 1464 | BORDETELLA PERTUSSIS | HANHYGTRI | 2347 | WP_019247158.1 |
| 1465 | BORDETELLA PERTUSSIS | HAQGKALLY | 2348 | AGT50936.1 |
| 1466 | BORDETELLA PERTUSSIS | HFIGYIYEV | 2349 | AAW72734.1 |
| 1467 | BORDETELLA PERTUSSIS | HLSPALADV | 2350 | AAA22983.1 |
| 1468 | BORDETELLA PERTUSSIS | HSLYASYEY | 2351 | AGS56996.1 |

-continued

| NO. | DISEASE | EPITOPE AMINO ACID SEQUENCE | SEQ ID NO | ACCESS. NO. |
|---|---|---|---|---|
| 1469 | BORDETELLA PERTUSSIS | HVRGMLVPV | 2352 | AAA22974.1 |
| 1470 | BORDETELLA PERTUSSIS | HVSKEEQYY | 2353 | YP_006628018.1 |
| 1471 | BORDETELLA PERTUSSIS | HVTRGWSIF | 2354 | AFK26303.1 |
| 1472 | BORDETELLA PERTUSSIS | IADSGFYLD | 2355 | AGS56996.1 |
| 1473 | BORDETELLA PERTUSSIS | IAHRTELRG | 2356 | AGS56996.1 |
| 1474 | BORDETELLA PERTUSSIS | IENTAKLSG | 2357 | WP_019249248.1 |
| 1475 | BORDETELLA PERTUSSIS | IESKISQSV | 2358 | WP_019249248.1 |
| 1476 | BORDETELLA PERTUSSIS | IETGGARRF | 2359 | AGT50936.1 |
| 1477 | BORDETELLA PERTUSSIS | IIKDAPPGA | 2360 | 1BCP_C |
| 1478 | BORDETELLA PERTUSSIS | IIQEFAADL | 2361 | WP_019249248.1 |
| 1479 | BORDETELLA PERTUSSIS | ILAGALATY | 2362 | AAW72734.1 |
| 1480 | BORDETELLA PERTUSSIS | ILLENPAAE | 2363 | AGS56996.1 |
| 1481 | BORDETELLA PERTUSSIS | ILPILVLAL | 2364 | NP_882286.1 |
| 1482 | BORDETELLA PERTUSSIS | IPFQRALRL | 2365 | WP_019248145.1 |
| 1483 | BORDETELLA PERTUSSIS | ISVRVHVSK | 2366 | YP_006628018.1 |
| 1484 | BORDETELLA PERTUSSIS | ITNETGKTY | 2367 | WP_019247158.1 |
| 1485 | BORDETELLA PERTUSSIS | ITNKRAALI | 2368 | WP_019249248.1 |
| 1486 | BORDETELLA PERTUSSIS | ITSYVGFSV | 2369 | WP_019248658.1 |
| 1487 | BORDETELLA PERTUSSIS | ITVTSRGGF | 2370 | WP_019249248.1 |
| 1488 | BORDETELLA PERTUSSIS | IVIPPKALF | 2371 | 1BCP_C |
| 1489 | BORDETELLA PERTUSSIS | IVVEAGELV | 2372 | WP_019249248.1 |
| 1490 | BORDETELLA PERTUSSIS | KAAKSVNLM | 2373 | WP_019247158.1 |
| 1491 | BORDETELLA PERTUSSIS | KAAPLRRTT | 2374 | AGS56996.1 |
| 1492 | BORDETELLA PERTUSSIS | KAGKLSATG | 2375 | WP_019249248.1 |
| 1493 | BORDETELLA PERTUSSIS | KAGTIAAPW | 2376 | WP_019249248.1 |

-continued

| NO. | DISEASE | EPITOPE AMINO ACID SEQUENCE | SEQ ID NO | ACCESS. NO. |
|---|---|---|---|---|
| 1494 | BORDETELLA PERTUSSIS | KAKSLTTEI | 2377 | WP_019249248.1 |
| 1495 | BORDETELLA PERTUSSIS | KATVTTVQV | 2378 | WP_019247158.1 |
| 1496 | BORDETELLA PERTUSSIS | KDYRDKDGG | 2379 | WP_019247158.1 |
| 1497 | BORDETELLA PERTUSSIS | KEAATIVAA | 2380 | WP_019249248.1 |
| 1498 | BORDETELLA PERTUSSIS | KEDVDAAQI | 2381 | WP_019248658.1 |
| 1499 | BORDETELLA PERTUSSIS | KEVDGIIQE | 2382 | WP_019249248.1 |
| 1500 | BORDETELLA PERTUSSIS | KGPKLAMPW | 2383 | AGS56996.1 |
| 1501 | BORDETELLA PERTUSSIS | KLASGGGAV | 2384 | WP_019249248.1 |
| 1502 | BORDETELLA PERTUSSIS | KLKGKNQEF | 2385 | AAA22984.1 |
| 1503 | BORDETELLA PERTUSSIS | KLLHHILPI | 2386 | NP_882286.1 |
| 1504 | BORDETELLA PERTUSSIS | KPAPQPGPQ | 2387 | AGS56996.1 |
| 1505 | BORDETELLA PERTUSSIS | KPAPTAPPM | 2388 | WP_019249248.1 |
| 1506 | BORDETELLA PERTUSSIS | KPAVSVKVA | 2389 | WP_019249248.1 |
| 1507 | BORDETELLA PERTUSSIS | KPDRAARVA | 2390 | WP_019249248.1 |
| 1508 | BORDETELLA PERTUSSIS | KPLADIAVI | 2391 | YP_006626470.1 |
| 1509 | BORDETELLA PERTUSSIS | KPLADIAVV | 2392 | WP_019249248.1 |
| 1510 | BORDETELLA PERTUSSIS | KPLPKPLPV | 2393 | WP_019247158.1 |
| 1511 | BORDETELLA PERTUSSIS | KQADRDFVW | 2394 | WP_019247699.1 |
| 1512 | BORDETELLA PERTUSSIS | KSLPGGKLP | 2395 | WP_019247158.1 |
| 1513 | BORDETELLA PERTUSSIS | KSYTLRYLA | 2396 | WP_019248658.1 |
| 1514 | BORDETELLA PERTUSSIS | KTNMVVTSV | 2397 | AAA22983.1 |
| 1515 | BORDETELLA PERTUSSIS | KVLAPRLYL | 2398 | AAA22974.1 |
| 1516 | BORDETELLA PERTUSSIS | KVLSTKTTL | 2399 | WP_019247158.1 |
| 1517 | BORDETELLA PERTUSSIS | LAAGAGLTL | 2400 | WP_019249248.1 |
| 1518 | BORDETELLA PERTUSSIS | LAAIASAAH | 2401 | WP_019248145.1 |

-continued

| NO. | DISEASE | EPITOPE AMINO ACID SEQUENCE | SEQ ID NO | ACCESS. NO. |
|---|---|---|---|---|
| 1519 | BORDETELLA PERTUSSIS | LAANGNGQW | 2402 | AGS56996.1 |
| 1520 | BORDETELLA PERTUSSIS | LAAQVTQRG | 2403 | WP_019249248.1 |
| 1521 | BORDETELLA PERTUSSIS | LAARGDGAL | 2404 | AAA22974.1 |
| 1522 | BORDETELLA PERTUSSIS | LAAVLVNPH | 2405 | WP_019249248.1 |
| 1523 | BORDETELLA PERTUSSIS | LAGSGLFRM | 2406 | AGS56996.1 |
| 1524 | BORDETELLA PERTUSSIS | LAKALSAAL | 2407 | WP_019249248.1 |
| 1525 | BORDETELLA PERTUSSIS | LALQAGDAL | 2408 | WP_019249248.1 |
| 1526 | BORDETELLA PERTUSSIS | LAMPWTFHA | 2409 | AGS56996.1 |
| 1527 | BORDETELLA PERTUSSIS | LANDGTIVI | 2410 | WP_019248658.1 |
| 1528 | BORDETELLA PERTUSSIS | LAPTVGVAF | 2411 | WP_019247158.1 |
| 1529 | BORDETELLA PERTUSSIS | LASDGSVDF | 2412 | AGS56996.1 |
| 1530 | BORDETELLA PERTUSSIS | LATYQSEYL | 2413 | AAW72734.1 |
| 1531 | BORDETELLA PERTUSSIS | LAWALMLAC | 2414 | AAA22974.1 |
| 1532 | BORDETELLA PERTUSSIS | LEAGRRFTH | 2415 | AGS56996.1 |
| 1533 | BORDETELLA PERTUSSIS | LFTQQGGAY | 2416 | 1BCP_C |
| 1534 | BORDETELLA PERTUSSIS | LKRPGSSPM | 2417 | AAA22983.1 |
| 1535 | BORDETELLA PERTUSSIS | LLGSHVARA | 2418 | AFK26303.1 |
| 1536 | BORDETELLA PERTUSSIS | LLHHILPIL | 2419 | NP_882286.1 |
| 1537 | BORDETELLA PERTUSSIS | LLNAGGTLL | 2420 | WP_019249248.1 |
| 1538 | BORDETELLA PERTUSSIS | LMGPLQVNA | 2421 | WP_019249248.1 |
| 1539 | BORDETELLA PERTUSSIS | LNDSKITMG | 2422 | WP_019248145.1 |
| 1540 | BORDETELLA PERTUSSIS | LPEPVKLTL | 2423 | AGT50936.1 |
| 1541 | BORDETELLA PERTUSSIS | LPILVLALL | 2424 | NP_882286.1 |
| 1542 | BORDETELLA PERTUSSIS | LPKISKNAL | 2425 | WP_019248145.1 |
| 1543 | BORDETELLA PERTUSSIS | LPKPVTVKL | 2426 | WP_019247158.1 |

| NO. | DISEASE | EPITOPE AMINO ACID SEQUENCE | SEQ ID NO | ACCESS. NO. |
|---|---|---|---|---|
| 1544 | BORDETELLA PERTUSSIS | LPLKANPMH | 2427 | NP_882285.1 |
| 1545 | BORDETELLA PERTUSSIS | LPPRPVVAE | 2428 | WP_019247158.1 |
| 1546 | BORDETELLA PERTUSSIS | LPSIPGTSI | 2429 | AGS56996.1 |
| 1547 | BORDETELLA PERTUSSIS | LPTHLYKNF | 2430 | AAA22984.1 |
| 1548 | BORDETELLA PERTUSSIS | LPVRGVALV | 2431 | WP_019249248.1 |
| 1549 | BORDETELLA PERTUSSIS | LPVSLTALD | 2432 | WP_019249248.1 |
| 1550 | BORDETELLA PERTUSSIS | LQGGNKVPV | 2433 | WP_019249248.1 |
| 1551 | BORDETELLA PERTUSSIS | LSAALGADW | 2434 | WP_019249248.1 |
| 1552 | BORDETELLA PERTUSSIS | LSDAGHEHD | 2435 | AAA22984.1 |
| 1553 | BORDETELLA PERTUSSIS | LSGEVQRKG | 2436 | WP_019249248.1 |
| 1554 | BORDETELLA PERTUSSIS | LSSPSAITV | 2437 | WP_019249248.1 |
| 1555 | BORDETELLA PERTUSSIS | LTWLAILAV | 2438 | AAW72734.1 |
| 1556 | BORDETELLA PERTUSSIS | LVFSHVRGM | 2439 | AAA22974.1 |
| 1557 | BORDETELLA PERTUSSIS | LVSDAGADL | 2440 | WP_019249248.1 |
| 1558 | BORDETELLA PERTUSSIS | LVYYESIAY | 2441 | AFK26302.1 |
| 1559 | BORDETELLA PERTUSSIS | MAAESTFES | 2442 | WP_019247158.1 |
| 1560 | BORDETELLA PERTUSSIS | MAAGHDATL | 2443 | WP_019249248.1 |
| 1561 | BORDETELLA PERTUSSIS | MAAWSERAG | 2444 | AFK26302.1 |
| 1562 | BORDETELLA PERTUSSIS | MALGALGAA | 2445 | AGS56996.1 |
| 1563 | BORDETELLA PERTUSSIS | MAPVMGACM | 2446 | ADA85123.1 |
| 1564 | BORDETELLA PERTUSSIS | MATKGEMQI | 2447 | WP_019249248.1 |
| 1565 | BORDETELLA PERTUSSIS | MDAKGGTLL | 2448 | WP_019249248.1 |
| 1566 | BORDETELLA PERTUSSIS | MESNKDIVI | 2449 | WP_019249248.1 |
| 1567 | BORDETELLA PERTUSSIS | MEVMLRAVF | 2450 | AAA22983.1 |
| 1568 | BORDETELLA PERTUSSIS | MEYFKTPLP | 2451 | WP_019249248.1 |

-continued

| NO. | DISEASE | EPITOPE AMINO ACID SEQUENCE | SEQ ID NO | ACCESS. NO. |
|---|---|---|---|---|
| 1569 | BORDETELLA PERTUSSIS | MHTIASILL | 2452 | AAA22984.1 |
| 1570 | BORDETELLA PERTUSSIS | MIYMSGLAV | 2453 | 1BCP_C |
| 1571 | BORDETELLA PERTUSSIS | MLACTGLPL | 2454 | AAA22974.1 |
| 1572 | BORDETELLA PERTUSSIS | MPIDRKTLC | 2455 | AFK26303.1 |
| 1573 | BORDETELLA PERTUSSIS | MPKAPELDL | 2456 | WP_019249248.1 |
| 1574 | BORDETELLA PERTUSSIS | MQRQAGLPL | 2457 | NP_882285.1 |
| 1575 | BORDETELLA PERTUSSIS | NALAWALML | 2458 | AAA22974.1 |
| 1576 | BORDETELLA PERTUSSIS | NITNKRAAL | 2459 | WP_019249248.1 |
| 1577 | BORDETELLA PERTUSSIS | NLMAAESTF | 2460 | WP_019247158.1 |
| 1578 | BORDETELLA PERTUSSIS | NNETMSGRQ | 2461 | WP_019249248.1 |
| 1579 | BORDETELLA PERTUSSIS | NPGSLIAEV | 2462 | WP_019249248.1 |
| 1580 | BORDETELLA PERTUSSIS | NPMHTIASI | 2463 | NP_882285.1 |
| 1581 | BORDETELLA PERTUSSIS | NPQTQLSNI | 2464 | WP_019248145.1 |
| 1582 | BORDETELLA PERTUSSIS | NPYTSRRSV | 2465 | AFK26302.1 |
| 1583 | BORDETELLA PERTUSSIS | PAPTAPPMP | 2466 | WP_019249248.1 |
| 1584 | BORDETELLA PERTUSSIS | PASANTLLL | 2467 | AGS56996.1 |
| 1585 | BORDETELLA PERTUSSIS | PAVALPRPL | 2468 | WP_019249248.1 |
| 1586 | BORDETELLA PERTUSSIS | PDAHVPFCF | 2469 | AAA22983.1 |
| 1587 | BORDETELLA PERTUSSIS | PELGAAIRV | 2470 | AGT50936.1 |
| 1588 | BORDETELLA PERTUSSIS | PFIIKLKDC | 2471 | WP_019248145.1 |
| 1589 | BORDETELLA PERTUSSIS | PGPQPPQPP | 2472 | AGS56996.1 |
| 1590 | BORDETELLA PERTUSSIS | PGPQPPQPQ | 2473 | AAZ74338.1 |
| 1591 | BORDETELLA PERTUSSIS | PGPTTDYST | 2474 | WP_019248145.1 |
| 1592 | BORDETELLA PERTUSSIS | PGTFTAGKD | 2475 | WP_019249248.1 |
| 1593 | BORDETELLA PERTUSSIS | PGTPGDLLE | 2476 | AAA22984.1 |

-continued

| NO. | DISEASE | EPITOPE AMINO ACID SEQUENCE | SEQ ID NO | ACCESS. NO. |
|---|---|---|---|---|
| 1594 | BORDETELLA PERTUSSIS | PKPKPKAER | 2477 | WP_019247158.1 |
| 1595 | BORDETELLA PERTUSSIS | PKPKPKPKA | 2478 | WP_019247158.1 |
| 1596 | BORDETELLA PERTUSSIS | PKPKPKPKP | 2479 | WP_019247158.1 |
| 1597 | BORDETELLA PERTUSSIS | PLPPRPVVA | 2480 | WP_019247158.1 |
| 1598 | BORDETELLA PERTUSSIS | PPAPKPAPQ | 2481 | AGS56996.1 |
| 1599 | BORDETELLA PERTUSSIS | PPKPAPVAK | 2482 | WP_019247158.1 |
| 1600 | BORDETELLA PERTUSSIS | PPRPVAAQV | 2483 | WP_019247158.1 |
| 1601 | BORDETELLA PERTUSSIS | PPRPVVAEK | 2484 | WP_019247158.1 |
| 1602 | BORDETELLA PERTUSSIS | PPSRPTTPP | 2485 | WP_019247158.1 |
| 1603 | BORDETELLA PERTUSSIS | PRRARRALR | 2486 | WP_019249248.1 |
| 1604 | BORDETELLA PERTUSSIS | QAAPLSITL | 2487 | AGT50936.1 |
| 1605 | BORDETELLA PERTUSSIS | QADRDFVWY | 2488 | WP_019247699.1 |
| 1606 | BORDETELLA PERTUSSIS | QAIVVGKDL | 2489 | WP_019249248.1 |
| 1607 | BORDETELLA PERTUSSIS | QALGALKLY | 2490 | ACI16088.1 |
| 1608 | BORDETELLA PERTUSSIS | QELALKLKG | 2491 | AAA22984.1 |
| 1609 | BORDETELLA PERTUSSIS | QITQHGGPY | 2492 | NP_882283.1 |
| 1610 | BORDETELLA PERTUSSIS | QITQHGSPY | 2493 | AFK26303.1 |
| 1611 | BORDETELLA PERTUSSIS | QPLPPRPVA | 2494 | WP_019247158.1 |
| 1612 | BORDETELLA PERTUSSIS | QPPAGRELS | 2495 | AGS56996.1 |
| 1613 | BORDETELLA PERTUSSIS | QQLKQADRD | 2496 | WP_019247699.1 |
| 1614 | BORDETELLA PERTUSSIS | QQVQVLQRQ | 2497 | WP_019247158.1 |
| 1615 | BORDETELLA PERTUSSIS | QSIVEAPEL | 2498 | AGT50936.1 |
| 1616 | BORDETELLA PERTUSSIS | QVGSSNSAF | 2499 | AAW72734.1 |
| 1617 | BORDETELLA PERTUSSIS | RAGLSPATW | 2500 | WP_019249248.1 |
| 1618 | BORDETELLA PERTUSSIS | RARRALRQD | 2501 | WP_019249248.1 |

-continued

| NO. | DISEASE | EPITOPE AMINO ACID SEQUENCE | SEQ ID NO | ACCESS. NO. |
|---|---|---|---|---|
| 1619 | BORDETELLA PERTUSSIS | RASASRARI | 2502 | WP_019249248.1 |
| 1620 | BORDETELLA PERTUSSIS | RELSAAANA | 2503 | AGS56996.1 |
| 1621 | BORDETELLA PERTUSSIS | RETFCITTI | 2504 | 1BCP_C |
| 1622 | BORDETELLA PERTUSSIS | RGFAQRQQL | 2505 | AGS56996.1 |
| 1623 | BORDETELLA PERTUSSIS | RGSAATFTL | 2506 | WP_019248295.1 |
| 1624 | BORDETELLA PERTUSSIS | RGWSIFALY | 2507 | AFK26303.1 |
| 1625 | BORDETELLA PERTUSSIS | RKMLYLIYV | 2508 | YP_006628018.1 |
| 1626 | BORDETELLA PERTUSSIS | RLRKMLYLI | 2509 | YP_006628018.1 |
| 1627 | BORDETELLA PERTUSSIS | RPQITDAVT | 2510 | WP_019249248.1 |
| 1628 | BORDETELLA PERTUSSIS | RPSVNGGRI | 2511 | WP_019249248.1 |
| 1629 | BORDETELLA PERTUSSIS | RRFTHADGW | 2512 | AGS56996.1 |
| 1630 | BORDETELLA PERTUSSIS | RSGARATSL | 2513 | AAA22974.1 |
| 1631 | BORDETELLA PERTUSSIS | RSRVRALAW | 2514 | NP_882284.1 |
| 1632 | BORDETELLA PERTUSSIS | RSRVRALSW | 2515 | YP_006628019.1 |
| 1633 | BORDETELLA PERTUSSIS | RTHGVGASL | 2516 | AGS56996.1 |
| 1634 | BORDETELLA PERTUSSIS | RTRGQARSG | 2517 | AAA22974.1 |
| 1635 | BORDETELLA PERTUSSIS | RVAPPAVAL | 2518 | WP_019249248.1 |
| 1636 | BORDETELLA PERTUSSIS | RVLPEPVKL | 2519 | AGT50936.1 |
| 1637 | BORDETELLA PERTUSSIS | RVRALAWLL | 2520 | NP_882284.1 |
| 1638 | BORDETELLA PERTUSSIS | RVRALSWLL | 2521 | YP_006628019.1 |
| 1639 | BORDETELLA PERTUSSIS | RVTVSGGSL | 2522 | AGT50936.1 |
| 1640 | BORDETELLA PERTUSSIS | SEAMAAWSE | 2523 | AFK26302.1 |
| 1641 | BORDETELLA PERTUSSIS | SESHNFHAS | 2524 | WP_019247158.1 |
| 1642 | BORDETELLA PERTUSSIS | SGEGRVNIG | 2525 | WP_019249248.1 |
| 1643 | BORDETELLA PERTUSSIS | SGLAVRVHV | 2526 | 1BCP_C |

-continued

| NO. | DISEASE | EPITOPE AMINO ACID SEQUENCE | SEQ ID NO | ACCESS. NO. |
|---|---|---|---|---|
| 1644 | BORDETELLA PERTUSSIS | SLADISLGA | 2527 | WP_019249248.1 |
| 1645 | BORDETELLA PERTUSSIS | SLFAILSST | 2528 | WP_019247158.1 |
| 1646 | BORDETELLA PERTUSSIS | SLFAPHGNV | 2529 | AAZ74338.1 |
| 1647 | BORDETELLA PERTUSSIS | SLSIDNATW | 2530 | AGS56996.1 |
| 1648 | BORDETELLA PERTUSSIS | SPMEVMLRA | 2531 | AAA22983.1 |
| 1649 | BORDETELLA PERTUSSIS | SPQPIRATV | 2532 | WP_019247158.1 |
| 1650 | BORDETELLA PERTUSSIS | SPRRARRAL | 2533 | WP_019249248.1 |
| 1651 | BORDETELLA PERTUSSIS | SPSRLAGTL | 2534 | WP_019249248.1 |
| 1652 | BORDETELLA PERTUSSIS | SSTPLGSLF | 2535 | WP_019247158.1 |
| 1653 | BORDETELLA PERTUSSIS | STYELLDYL | 2536 | WP_019249248.1 |
| 1654 | BORDETELLA PERTUSSIS | SVAMKPYEV | 2537 | AAA22983.1 |
| 1655 | BORDETELLA PERTUSSIS | SVAPNALAW | 2538 | AAA22974.1 |
| 1656 | BORDETELLA PERTUSSIS | SVKVAKKLF | 2539 | WP_019249248.1 |
| 1657 | BORDETELLA PERTUSSIS | TAFMSGRSL | 2540 | AAA22984.1 |
| 1658 | BORDETELLA PERTUSSIS | TAGATPFDI | 2541 | WP_019248658.1 |
| 1659 | BORDETELLA PERTUSSIS | TAPVTSPAW | 2542 | AAW72734.1 |
| 1660 | BORDETELLA PERTUSSIS | TARTGWLTW | 2543 | AAW72734.1 |
| 1661 | BORDETELLA PERTUSSIS | TEAQGVQVR | 2544 | WP_019248145.1 |
| 1662 | BORDETELLA PERTUSSIS | TEVYLEHRM | 2545 | AAW72734.1 |
| 1663 | BORDETELLA PERTUSSIS | TFEGKPALE | 2546 | AAA22983.1 |
| 1664 | BORDETELLA PERTUSSIS | TFTGKVTNG | 2547 | WP_019248658.1 |
| 1665 | BORDETELLA PERTUSSIS | TGDGGHTD | 2548 | AGS56996.1 |
| 1666 | BORDETELLA PERTUSSIS | TLAKALSAA | 2549 | WP_019249248.1 |
| 1667 | BORDETELLA PERTUSSIS | TLANVGDTW | 2550 | AGS56996.1 |
| 1668 | BORDETELLA PERTUSSIS | TLNASNLTL | 2551 | WP_019249248.1 |

-continued

| NO. | DISEASE | EPITOPE AMINO ACID SEQUENCE | SEQ ID NO | ACCESS. NO. |
|---|---|---|---|---|
| 1669 | BORDETELLA PERTUSSIS | TLSSAHGNV | 2552 | WP_019249248.1 |
| 1670 | BORDETELLA PERTUSSIS | TPFDIKLKE | 2553 | WP_019248658.1 |
| 1671 | BORDETELLA PERTUSSIS | TPFIIKLKD | 2554 | WP_019248145.1 |
| 1672 | BORDETELLA PERTUSSIS | TPGWSIYGL | 2555 | 1BCP_C |
| 1673 | BORDETELLA PERTUSSIS | TPLGSAATF | 2556 | AGS56996.1 |
| 1674 | BORDETELLA PERTUSSIS | TPLGSLFAI | 2557 | WP_019247158.1 |
| 1675 | BORDETELLA PERTUSSIS | TPLPVSLTA | 2558 | WP_019249248.1 |
| 1676 | BORDETELLA PERTUSSIS | TRQGIMDQY | 2559 | YP_006626873.1 |
| 1677 | BORDETELLA PERTUSSIS | TSKQDERNY | 2560 | WP_019247158.1 |
| 1678 | BORDETELLA PERTUSSIS | TSPYDGKYW | 2561 | YP_006628018.1 |
| 1679 | BORDETELLA PERTUSSIS | TSRRSVASI | 2562 | AFK26302.1 |
| 1680 | BORDETELLA PERTUSSIS | TSRTVTMRY | 2563 | NP_879898.1 |
| 1681 | BORDETELLA PERTUSSIS | TTEYPNARY | 2564 | ADA85123.1 |
| 1682 | BORDETELLA PERTUSSIS | TTEYSNARY | 2565 | AFK26302.1 |
| 1683 | BORDETELLA PERTUSSIS | TTLGLEQTF | 2566 | WP_019247158.1 |
| 1684 | BORDETELLA PERTUSSIS | TVLAAGAGL | 2567 | WP_019249248.1 |
| 1685 | BORDETELLA PERTUSSIS | TVQELALKL | 2568 | AAA22984.1 |
| 1686 | BORDETELLA PERTUSSIS | TVVQRNKHW | 2569 | WP_019247158.1 |
| 1687 | BORDETELLA PERTUSSIS | VAAADLAL | 2570 | WP_019249248.1 |
| 1688 | BORDETELLA PERTUSSIS | VALASQARW | 2571 | AGS56996.1 |
| 1689 | BORDETELLA PERTUSSIS | VAMKPYEVT | 2572 | AAA22983.1 |
| 1690 | BORDETELLA PERTUSSIS | VARLVKLQG | 2573 | WP_019249248.1 |
| 1691 | BORDETELLA PERTUSSIS | VAVAGGRWH | 2574 | AGS56996.1 |
| 1692 | BORDETELLA PERTUSSIS | VEASAITTY | 2575 | WP_019248145.1 |
| 1693 | BORDETELLA PERTUSSIS | VEDIGGKNY | 2576 | WP_019247158.1 |

| NO. | DISEASE | EPITOPE AMINO ACID SEQUENCE | SEQ ID NO | ACCESS. NO. |
|---|---|---|---|---|
| 1694 | BORDETELLA PERTUSSIS | VEVSPPPV | 2577 | WP_019247158.1 |
| 1695 | BORDETELLA PERTUSSIS | VGAGGYEAG | 2578 | WP_019247158.1 |
| 1696 | BORDETELLA PERTUSSIS | VGGGEHGRW | 2579 | WP_019249248.1 |
| 1697 | BORDETELLA PERTUSSIS | VHVSKEEQY | 2580 | YP_006628018.1 |
| 1698 | BORDETELLA PERTUSSIS | VIDGQKVLA | 2581 | AAA22974.1 |
| 1699 | BORDETELLA PERTUSSIS | VIGACTSPY | 2582 | YP_006628018.1 |
| 1700 | BORDETELLA PERTUSSIS | VKLGGVYEA | 2583 | AAA22974.1 |
| 1701 | BORDETELLA PERTUSSIS | VLAPRLYLT | 2584 | AAA22974.1 |
| 1702 | BORDETELLA PERTUSSIS | VLVKTNMVV | 2585 | AAA22983.1 |
| 1703 | BORDETELLA PERTUSSIS | VPASGAPAA | 2586 | AGS56996.1 |
| 1704 | BORDETELLA PERTUSSIS | VPFCFGKDL | 2587 | AAA22983.1 |
| 1705 | BORDETELLA PERTUSSIS | VPVSEHCTV | 2588 | AAA22974.1 |
| 1706 | BORDETELLA PERTUSSIS | VPVTPPKVE | 2589 | WP_019247158.1 |
| 1707 | BORDETELLA PERTUSSIS | VRTVSAMEY | 2590 | WP_019249248.1 |
| 1708 | BORDETELLA PERTUSSIS | VSGGSLSAP | 2591 | AGT50936.1 |
| 1709 | BORDETELLA PERTUSSIS | VSSATKAKG | 2592 | WP_019248658.1 |
| 1710 | BORDETELLA PERTUSSIS | VSSPPPVSV | 2593 | WP_019247158.1 |
| 1711 | BORDETELLA PERTUSSIS | VSVKVAKKL | 2594 | WP_019249248.1 |
| 1712 | BORDETELLA PERTUSSIS | VTMRYLASY | 2595 | WP_019248145.1 |
| 1713 | BORDETELLA PERTUSSIS | VTSVAMKPY | 2596 | AAA22983.1 |
| 1714 | BORDETELLA PERTUSSIS | VVAEKVTTP | 2597 | WP_019247158.1 |
| 1715 | BORDETELLA PERTUSSIS | VVDGPPSRP | 2598 | WP_019247158.1 |
| 1716 | BORDETELLA PERTUSSIS | VVETAQPLP | 2599 | WP_019247158.1 |
| 1717 | BORDETELLA PERTUSSIS | WLTWLAILA | 2600 | AAW72734.1 |
| 1718 | BORDETELLA PERTUSSIS | WTFHAGYRY | 2601 | AGS56996.1 |

-continued

| NO. | DISEASE | EPITOPE AMINO ACID SEQUENCE | SEQ ID NO | ACCESS. NO. |
|---|---|---|---|---|
| 1719 | BORDETELLA PERTUSSIS | WVMTDNSNV | 2602 | AGS56996.1 |
| 1720 | BORDETELLA PERTUSSIS | YAEHGEVSI | 2603 | WP_019249248.1 |
| 1721 | BORDETELLA PERTUSSIS | YAIDGTAAG | 2604 | WP_019249248.1 |
| 1722 | BORDETELLA PERTUSSIS | YALKSRIAL | 2605 | AAA22984.1 |
| 1723 | BORDETELLA PERTUSSIS | YATNPQTQL | 2606 | WP_019248145.1 |
| 1724 | BORDETELLA PERTUSSIS | YDTGDLIAY | 2607 | WP_019248658.1 |
| 1725 | BORDETELLA PERTUSSIS | YEAGFSLGS | 2608 | WP_019247158.1 |
| 1726 | BORDETELLA PERTUSSIS | YEDATFETY | 2609 | YP_006628018.1 |
| 1727 | BORDETELLA PERTUSSIS | YENKSSTPL | 2610 | WP_019247158.1 |
| 1728 | BORDETELLA PERTUSSIS | YEVTPTRML | 2611 | AAA22983.1 |
| 1729 | BORDETELLA PERTUSSIS | YEYIWGLYP | 2612 | WP_019249248.1 |
| 1730 | BORDETELLA PERTUSSIS | YEYIWGLYQ | 2613 | YP_006626470.1 |
| 1731 | BORDETELLA PERTUSSIS | YEYSKGPKL | 2614 | AGS56996.1 |
| 1732 | BORDETELLA PERTUSSIS | YFEPGPTTD | 2615 | WP_019248145.1 |
| 1733 | BORDETELLA PERTUSSIS | YIWGLYPTY | 2616 | WP_019249248.1 |
| 1734 | BORDETELLA PERTUSSIS | YIWGLYQTY | 2617 | YP_006626470.1 |
| 1735 | BORDETELLA PERTUSSIS | YLRQITPGW | 2618 | 1BCP_C |
| 1736 | BORDETELLA PERTUSSIS | YMIYMSGLA | 2619 | 1BCP_C |
| 1737 | BORDETELLA PERTUSSIS | YPALRAALI | 2620 | WP_019248658.1 |
| 1738 | BORDETELLA PERTUSSIS | YPGTPGDLL | 2621 | AAA22984.1 |
| 1739 | BORDETELLA PERTUSSIS | YPTYTEWSV | 2622 | WP_019249248.1 |
| 1740 | BORDETELLA PERTUSSIS | YQTYTEWSV | 2623 | YP_006626470.1 |
| 1741 | BORDETELLA PERTUSSIS | YSTGDLRAY | 2624 | WP_019248145.1 |
| 1742 | BORDETELLA PERTUSSIS | YTLRYLASY | 2625 | WP_019248658.1 |
| 1743 | BORDETELLA PERTUSSIS | YVLVKTNMV | 2626 | AAA22983.1 |

-continued

| NO. | DISEASE | EPITOPE AMINO ACID SEQUENCE | SEQ ID NO | ACCESS. NO. |
|---|---|---|---|---|
| 1744 | BORDETELLA PERTUSSIS | YYDYEDATF | 2627 | YP_006628018.1 |
| 1745 | BORDETELLA PERTUSSIS 509 | AAFIALYPNSQLAPT | 2628 | Q7VU05 |
| 1746 | BORDETELLA PERTUSSIS 509 | GGAEYNLALGQRRA | 2629 | Q7VU04 |
| 1747 | BORDETELLA PERTUSSIS 509 | GGAEYNLALGQRRADA | 2630 | Q7VU04 |
| 1748 | BORDETELLA PERTUSSIS 509 | IALYPNSQLAPT | 2631 | Q7VU05 |
| 1749 | BORDETELLA PERTUSSIS 509 | KPDQGEVVAVGPGKKTED | 2632 | P0A339.1 |
| 1750 | BORDETELLA PERTUSSIS 509 | KPDQGEVVAVGPGKKTEDG | 2633 | P0A339.1 |
| 1751 | BORDETELLA PERTUSSIS 509 | LAEVLDYHNFVLTQ | 2634 | Q7VWM1.1 |
| 1752 | CORYNEBACTERIUM DIPHTHERIAE | QSIALSSLMVAQAIP | 2635 | AAV70486.1 |
| 1753 | CORYNEBACTERIUM DIPHTHERIAE | SIGVLGYQKTVDHTKVNSKLSLF | 2636 | AAV70486.1 |
| 1754 | BORDETELLA PERTUSSIS | AAHADWNNQSIVKT | 2637 | ABO77783.1 |
| 1755 | BORDETELLA PERTUSSIS | AALGRG | 2638 | ABO77783.1 |
| 1756 | BORDETELLA PERTUSSIS | AALGRGHSLYASYE | 2639 | ABO77783.1 |
| 1757 | BORDETELLA PERTUSSIS | AAPLRRTTLAMALG | 2640 | ABO77783.1 |
| 1758 | BORDETELLA PERTUSSIS | AAPLSITLQAGAHA | 2641 | ABO77783.1 |
| 1759 | BORDETELLA PERTUSSIS | ADAQGDIVATELPS | 2642 | ABO77783.1 |
| 1760 | BORDETELLA PERTUSSIS | ADSGFYLDATLRAS | 2643 | ABO77783.1 |
| 1761 | BORDETELLA PERTUSSIS | AELA | 2644 | ABO77783.1 |
| 1762 | BORDETELLA PERTUSSIS | AELAVFRAGGGAYR | 2645 | ABO77783.1 |
| 1763 | BORDETELLA PERTUSSIS | AELQFRNGSVTSSG | 2646 | ABO77783.1 |
| 1764 | BORDETELLA PERTUSSIS | AGGRWHLGGLAGYT | 2647 | ABO77783.1 |
| 1765 | BORDETELLA PERTUSSIS | AGVAAMQGAVVHLQ | 2648 | ABO77783.1 |
| 1766 | BORDETELLA PERTUSSIS | AGYTRGDRGFTGDG | 2649 | ABO77783.1 |
| 1767 | BORDETELLA PERTUSSIS | ALASQARWTGATRA | 2650 | ABO77783.1 |
| 1768 | BORDETELLA PERTUSSIS | AMPWTFHAGYRYSW | 2651 | ABO77783.1 |

| NO. | DISEASE | EPITOPE AMINO ACID SEQUENCE | SEQ ID NO | ACCESS. NO. |
|---|---|---|---|---|
| 1769 | BORDETELLA PERTUSSIS | AMQGAVVHLQRATIRRGDAP | 2652 | ABO77783.1 |
| 1770 | BORDETELLA PERTUSSIS | ANGLRVRDE | 2653 | ABO77783.1 |
| 1771 | BORDETELLA PERTUSSIS | ANGLRVRDEGGSSV | 2654 | ABO77783.1 |
| 1772 | BORDETELLA PERTUSSIS | ANKDGKVDIGTYRY | 2655 | ABO77783.1 |
| 1773 | BORDETELLA PERTUSSIS | APAAVSVLGASELT | 2656 | ABO77783.1 |
| 1774 | BORDETELLA PERTUSSIS | APPAPKPAPQPGPQ | 2657 | ABO77783.1 |
| 1775 | BORDETELLA PERTUSSIS | AQGILLENPAAELQ | 2658 | ABO77783.1 |
| 1776 | BORDETELLA PERTUSSIS | ARWTGATRAVDSLS | 2659 | ABO77783.1 |
| 1777 | BORDETELLA PERTUSSIS | ASLEAGRRFTHADG | 2660 | ABO77783.1 |
| 1778 | BORDETELLA PERTUSSIS | ASYEYSKGPKLAMP | 2661 | ABO77783.1 |
| 1779 | BORDETELLA PERTUSSIS | ATFTLANKD | 2662 | ABO77783.1 |
| 1780 | BORDETELLA PERTUSSIS | ATFTLANKDGKVDI | 2663 | ABO77783.1 |
| 1781 | BORDETELLA PERTUSSIS | ATRAVDSLSIDNAT | 2664 | ABO77783.1 |
| 1782 | BORDETELLA PERTUSSIS | DDDGIALYVAGEQAQ | 2665 | ABO77783.1 |
| 1783 | BORDETELLA PERTUSSIS | DDGIALYVAGEQAQ | 2666 | ABO77783.1 |
| 1784 | BORDETELLA PERTUSSIS | DGGHITGGRAAGVA | 2667 | ABO77783.1 |
| 1785 | BORDETELLA PERTUSSIS | DGIRRFLGTVTVKAGK | 2668 | ABO77783.1 |
| 1786 | BORDETELLA PERTUSSIS | DGSVDFQQPAEAGR | 2669 | ABO77783.1 |
| 1787 | BORDETELLA PERTUSSIS | DGYAVKGKYRTHGV | 2670 | ABO77783.1 |
| 1788 | BORDETELLA PERTUSSIS | DIVATELPSIPGTS | 2671 | ABO77783.1 |
| 1789 | BORDETELLA PERTUSSIS | DKLVVMQDASGQHR | 2672 | ABO77783.1 |
| 1790 | BORDETELLA PERTUSSIS | DLGLSDKLVVMQDA | 2673 | ABO77783.1 |
| 1791 | BORDETELLA PERTUSSIS | DNATWVMTDNSNVGA | 2674 | ABO77783.1 |
| 1792 | BORDETELLA PERTUSSIS | DNATWVMTDNSNVGALRLA | 2675 | ABO77783.1 |
| 1793 | BORDETELLA PERTUSSIS | DNRAGRRFDQKVAG | 2676 | ABO77783.1 |

-continued

| NO. | DISEASE | EPITOPE AMINO ACID SEQUENCE | SEQ ID NO | ACCESS. NO. |
|---|---|---|---|---|
| 1794 | BORDETELLA PERTUSSIS | EAGRFKVLTVNTLA | 2677 | ABO77783.1 |
| 1795 | BORDETELLA PERTUSSIS | ELAQSIVEAPELGA | 2678 | ABO77783.1 |
| 1796 | BORDETELLA PERTUSSIS | ELGAAIRVGRGARV | 2679 | ABO7783.1 |
| 1797 | BORDETELLA PERTUSSIS | ELGADHAVAVAGGR | 2680 | ABO77783.1 |
| 1798 | BORDETELLA PERTUSSIS | ELPSIPGTSIGPLD | 2681 | ABO77783.1 |
| 1799 | BORDETELLA PERTUSSIS | EPVKLTLTGGADAQ | 2682 | ABO77783.1 |
| 1800 | BORDETELLA PERTUSSIS | EQAQASIADSTLQG | 2683 | ABO77783.1 |
| 1801 | BORDETELLA PERTUSSIS | ERGANVTVQRSAIV | 2684 | ABO77783.1 |
| 1802 | BORDETELLA PERTUSSIS | ERQHGIHIQGSDPG | 2685 | ABO77783.1 |
| 1803 | BORDETELLA PERTUSSIS | EVGKRIELAGGRQV | 2686 | ABO77783.1 |
| 1804 | BORDETELLA PERTUSSIS | FDGAGTVHTNGIAH | 2687 | ABO77783.1 |
| 1805 | BORDETELLA PERTUSSIS | FQQPAEAGRFKVLT | 2688 | ABO77783.1 |
| 1806 | BORDETELLA PERTUSSIS | FRAGGGAYRAANGL | 2689 | ABO77783.1 |
| 1807 | BORDETELLA PERTUSSIS | GAHAQGKALLYRVL | 2690 | ABO77783.1 |
| 1808 | BORDETELLA PERTUSSIS | GARVTVSGGSLSAP | 2691 | ABO77783.1 |
| 1809 | BORDETELLA PERTUSSIS | GAYRAANGLRVRDE | 2692 | ABO77783.1 |
| 1810 | BORDETELLA PERTUSSIS | GDAPAGGAVPGGAV | 2693 | ABO77783.1 |
| 1811 | BORDETELLA PERTUSSIS | GGAVPGGAVPGGFG | 2694 | ABO77783.1 |
| 1812 | BORDETELLA PERTUSSIS | GGAVPGGFGPVLDG | 2695 | ABO77783.1 |
| 1813 | BORDETELLA PERTUSSIS | GGFGPVLDGWYGVD | 2696 | ABO77783.1 |
| 1814 | BORDETELLA PERTUSSIS | GGLHIGALQSLQPE | 2697 | ABO77783.1 |
| 1815 | BORDETELLA PERTUSSIS | GGVQIERGANVTVQ | 2698 | ABO77783.1 |
| 1816 | BORDETELLA PERTUSSIS | GHSLYASYEYSKGP | 2699 | ABO77783.1 |
| 1817 | BORDETELLA PERTUSSIS | GHTDSVHVGGYATY | 2700 | ABO77783.1 |
| 1818 | BORDETELLA PERTUSSIS | GIAHRTELRGTRAE | 2701 | ABO77783.1 |

| NO. | DISEASE | EPITOPE AMINO ACID SEQUENCE | SEQ ID NO | ACCESS. NO. |
|---|---|---|---|---|
| 1819 | BORDETELLA PERTUSSIS | GKALLYRVLPEPVK | 2702 | ABO77783.1 |
| 1820 | BORDETELLA PERTUSSIS | GLGMAAALGRGHSL | 2703 | ABO77783.1 |
| 1821 | BORDETELLA PERTUSSIS | GNVIETGGARRFAP | 2704 | ABO77783.1 |
| 1822 | BORDETELLA PERTUSSIS | GPLDVALASQARWT | 2705 | ABO77783.1 |
| 1823 | BORDETELLA PERTUSSIS | GQHRLWVRN | 2706 | ABO77783.1 |
| 1824 | BORDETELLA PERTUSSIS | GRGFAQRQQLDNRA | 2707 | ABO77783.1 |
| 1825 | BORDETELLA PERTUSSIS | GRLGLEVGKRIELA | 2708 | ABO77783.1 |
| 1826 | BORDETELLA PERTUSSIS | GRQVQPYIKASVLQ | 2709 | ABO77783.1 |
| 1827 | BORDETELLA PERTUSSIS | GRRFTHADGWFLEPQAELA | 2710 | ABO77783.1 |
| 1828 | BORDETELLA PERTUSSIS | GSEPASANTLLLVQ | 2711 | ABO77783.1 |
| 1829 | BORDETELLA PERTUSSIS | GSSVLGRLGLEVGK | 2712 | ABO77783.1 |
| 1830 | BORDETELLA PERTUSSIS | GTTIKVSGRQAQGI | 2713 | ABO77783.1 |
| 1831 | BORDETELLA PERTUSSIS | GTVTVKAGKLVADH | 2714 | ABO77783.1 |
| 1832 | BORDETELLA PERTUSSIS | HAVAVAGGRWHLGG | 2715 | ABO77783.1 |
| 1833 | BORDETELLA PERTUSSIS | IELAGGRQVQPYIK | 2716 | ABO77783.1 |
| 1834 | BORDETELLA PERTUSSIS | IHIQGSDPGGVRTA | 2717 | ABO77783.1 |
| 1835 | BORDETELLA PERTUSSIS | IRRFLGTVTVKAGK | 2718 | ABO77783.1 |
| 1836 | BORDETELLA PERTUSSIS | IRVGRGARVTVSGG | 2719 | ABO77783.1 |
| 1837 | BORDETELLA PERTUSSIS | ITLQAGAHA | 2720 | ABO77783.1 |
| 1883 | BORDETELLA PERTUSSIS | ITLQAGAHAQGKAL | 2721 | ABO77783.1 |
| 1839 | BORDETELLA PERTUSSIS | IVEAPELGAAIRVG | 2722 | ABO77783.1 |
| 1840 | BORDETELLA PERTUSSIS | IVKTGERQHGIHIQ | 2723 | ABO77783.1 |
| 1841 | BORDETELLA PERTUSSIS | KAGKLVADHATLAN | 2724 | ABO77783.1 |
| 1842 | BORDETELLA PERTUSSIS | KGKYRTHGVGASLE | 2725 | ABO77783.1 |
| 1843 | BORDETELLA PERTUSSIS | KPAPQPGPQPPQPP | 2726 | ABO77783.1 |

-continued

| NO. | DISEASE | EPITOPE AMINO ACID SEQUENCE | SEQ ID NO | ACCESS. NO. |
|---|---|---|---|---|
| 1844 | BORDETELLA PERTUSSIS | KVAGFELGADHAVA | 2727 | ABO77783.1 |
| 1845 | BORDETELLA PERTUSSIS | KVAGSDGYAVKGKY | 2728 | ABO77783.1 |
| 1846 | BORDETELLA PERTUSSIS | KVDIGTYRYRLAAN | 2729 | ABO77783.1 |
| 1847 | BORDETELLA PERTUSSIS | KVLTVNTLAGSGLF | 2730 | ABO77783.1 |
| 1848 | BORDETELLA PERTUSSIS | LAANGNGQWSLVGA | 2731 | ABO77783.1 |
| 1849 | BORDETELLA PERTUSSIS | LAMPWTFHAGYRYS | 2732 | ABO77783.1 |
| 1850 | BORDETELLA PERTUSSIS | LASTLWYAESNALS | 2733 | ABO77783.1 |
| 1851 | BORDETELLA PERTUSSIS | LENDFKVAGSDGYA | 2734 | ABO77783.1 |
| 1852 | BORDETELLA PERTUSSIS | LENPAAELQFRNGS | 2735 | ABO77783.1 |
| 1853 | BORDETELLA PERTUSSIS | LGAAPAAHADWNNQ | 2736 | ABO77783.1 |
| 1854 | BORDETELLA PERTUSSIS | LGGLAGYTRGDRGFTGDG | 2737 | ABO77783.1 |
| 1855 | BORDETELLA PERTUSSIS | LLENP | 2738 | ABO77783.1 |
| 1856 | BORDETELLA PERTUSSIS | LLVQTPLGSAATFT | 2739 | ABO77783.1 |
| 1857 | BORDETELLA PERTUSSIS | LPPSRVVLRDTNVT | 2740 | ABO77783.1 |
| 1858 | BORDETELLA PERTUSSIS | LQPEDLPPS | 2741 | ABO77783.1 |
| 1859 | BORDETELLA PERTUSSIS | LQPEDLPPSRVVLR | 2742 | ABO77783.1 |
| 1860 | BORDETELLA PERTUSSIS | LRASRLENDFKVAG | 2743 | ABO77783.1 |
| 1861 | BORDETELLA PERTUSSIS | LRLASDGSVDFQQP | 2744 | ABO77783.1 |
| 1862 | BORDETELLA PERTUSSIS | LSAAANAAVNTGGV | 2745 | ABO77783.1 |
| 1863 | BORDETELLA PERTUSSIS | LSAPHGNVIETGGA | 2746 | ABO77783.1 |
| 1864 | BORDETELLA PERTUSSIS | LSDDGIRRFLGTVT | 2747 | ABO77783.1 |
| 1865 | BORDETELLA PERTUSSIS | LVGAKAPPAPKPAP | 2748 | ABO77783.1 |
| 1866 | BORDETELLA PERTUSSIS | LYVAGEQAQASIAD | 2749 | ABO77783.1 |
| 1867 | BORDETELLA PERTUSSIS | MALGALGAAPAAHA | 2750 | ABO77783.1 |
| 1868 | BORDETELLA PERTUSSIS | MNMSLSRIVKAAPL | 2751 | ABO77783.1 |

| NO. | DISEASE | EPITOPE AMINO ACID SEQUENCE | SEQ ID NO | ACCESS. NO. |
| --- | --- | --- | --- | --- |
| 1869 | BORDETELLA PERTUSSIS | MQDASGQHR | 2752 | ABO77783.1 |
| 1870 | BORDETELLA PERTUSSIS | MQGAVVHLQRATIR | 2753 | ABO77783.1 |
| 1871 | BORDETELLA PERTUSSIS | NAAVNTGGVGLAST | 2754 | ABO77783.1 |
| 1872 | BORDETELLA PERTUSSIS | NALSKRLGELRLNP | 2755 | ABO77783.1 |
| 1873 | BORDETELLA PERTUSSIS | NGQWSLVGAKAPPA | 2756 | ABO77783.1 |
| 1874 | BORDETELLA PERTUSSIS | NTLAGSGLFRMNVF | 2757 | ABO77783.1 |
| 1875 | BORDETELLA PERTUSSIS | PAGRELSAAANAAV | 2758 | ABO77783.1 |
| 1876 | BORDETELLA PERTUSSIS | PAPQPPAGRELSAA | 2759 | ABO77783.1 |
| 1877 | BORDETELLA PERTUSSIS | PGPQPPQPPQPQPE | 2760 | ABO77783.1 |
| 1878 | BORDETELLA PERTUSSIS | PGTSIGPLDVALAS | 2761 | ABO77783.1 |
| 1879 | BORDETELLA PERTUSSIS | PLGSAATFTLANKD | 2762 | ABO77783.1 |
| 1880 | BORDETELLA PERTUSSIS | PQPEAPAPQPPAGR | 2763 | ABO77783.1 |
| 1881 | BORDETELLA PERTUSSIS | PQPPQPQPEAPAPQ | 2764 | ABO77783.1 |
| 1882 | BORDETELLA PERTUSSIS | PYIKASVLQEFDGA | 2765 | ABO77783.1 |
| 1883 | BORDETELLA PERTUSSIS | RFAPQAAPLSITLQ | 2766 | ABO77783.1 |
| 1884 | BORDETELLA PERTUSSIS | RLGELRLNPDAGGA | 2767 | ABO77783.1 |
| 1885 | BORDETELLA PERTUSSIS | RLNPDAGGAWGRGF | 2768 | ABO77783.1 |
| 1886 | BORDETELLA PERTUSSIS | RNGSVTSSGQLSDD | 2769 | ABO77783.1 |
| 1887 | BORDETELLA PERTUSSIS | RRFDQKVAGFELGA | 2770 | ABO77783.1 |
| 1888 | BORDETELLA PERTUSSIS | RTTLAMALGALGAA | 2771 | ABO77783.1 |
| 1889 | BORDETELLA PERTUSSIS | SAIVDGGLHIGALQ | 2772 | ABO77783.1 |
| 1890 | BORDETELLA PERTUSSIS | SANTLLLVQTPLGS | 2773 | ABO77783.1 |
| 1891 | BORDETELLA PERTUSSIS | SDPGGVRTASGTTI | 2774 | ABO77783.1 |
| 1892 | BORDETELLA PERTUSSIS | SELTLDGGHITGGR | 2775 | ABO77783.1 |
| 1893 | BORDETELLA PERTUSSIS | SGLFRMNVF | 2776 | ABO77783.1 |

-continued

| NO. | DISEASE | EPITOPE AMINO ACID SEQUENCE | SEQ ID NO | ACCESS. NO. |
|---|---|---|---|---|
| 1894 | BORDETELLA PERTUSSIS | SGLFRMNVFADLGL | 2777 | ABO77783.1 |
| 1895 | BORDETELLA PERTUSSIS | SGSSVELAQSIVEA | 2778 | ABO77783.1 |
| 1896 | BORDETELLA PERTUSSIS | SIADSTLQGAGGVQ | 2779 | ABO77783.1 |
| 1897 | BORDETELLA PERTUSSIS | SKGPKLAMPWTFHA | 2780 | ABO77783.1 |
| 1898 | BORDETELLA PERTUSSIS | SNVGALRLASDGSV | 2781 | ABO77783.1 |
| 1899 | BORDETELLA PERTUSSIS | SRIVKAAPLRRTTL | 2782 | ABO77783.1 |
| 1900 | BORDETELLA PERTUSSIS | SVLGASELTLDGGH | 2783 | ABO77783.1 |
| 1901 | BORDETELLA PERTUSSIS | SVLQEFDGA | 2784 | ABO77783.1 |
| 1902 | BORDETELLA PERTUSSIS | SVLQEFDGAGTVHT | 2785 | ABO77783.1 |
| 1903 | BORDETELLA PERTUSSIS | TELR | 2786 | ABO77783.1 |
| 1904 | BORDETELLA PERTUSSIS | TELRGTRAELGLGM | 2787 | ABO77783.1 |
| 1905 | BORDETELLA PERTUSSIS | TGDGGGHTDSVHVG | 2788 | ABO77783.1 |
| 1906 | BORDETELLA PERTUSSIS | TGGARRFAPQAAPL | 2789 | ABO77783.1 |
| 1907 | BORDETELLA PERTUSSIS | TGGRAAGVAAMQGA | 2790 | ABO77783.1 |
| 1908 | BORDETELLA PERTUSSIS | TGGVGLASTLWYAE | 2791 | ABO77783.1 |
| 1909 | BORDETELLA PERTUSSIS | THGVGASLEAGRRF | 2792 | ABO77783.1 |
| 1910 | BORDETELLA PERTUSSIS | TIRRGDAPA | 2793 | ABO77783.1 |
| 1911 | BORDETELLA PERTUSSIS | TLANVGDTWDDDGI | 2794 | ABO77783.1 |
| 1912 | BORDETELLA PERTUSSIS | TLQGAGGVQIERGA | 2795 | ABO77783.1 |
| 1913 | BORDETELLA PERTUSSIS | TLTGGADAQGDIVA | 2796 | ABO77783.1 |
| 1914 | BORDETELLA PERTUSSIS | TNVTAVPASGAPAA | 2797 | ABO77783.1 |
| 1915 | BORDETELLA PERTUSSIS | TRAELGLGMAAALG | 2798 | ABO77783.1 |
| 1916 | BORDETELLA PERTUSSIS | TSSGQLSDDGIRRF | 2799 | ABO77783.1 |
| 1917 | BORDETELLA PERTUSSIS | TVHTNGIAHRTELR | 2800 | ABO77783.1 |
| 1918 | BORDETELLA PERTUSSIS | TYRYRLAANGNGQW | 2801 | ABO77783.1 |

-continued

| NO. | DISEASE | EPITOPE AMINO ACID SEQUENCE | SEQ ID NO | ACCESS. NO. |
|---|---|---|---|---|
| 1919 | BORDETELLA PERTUSSIS | VADHATLANVGDTW | 2802 | ABO77783.1 |
| 1920 | BORDETELLA PERTUSSIS | VHVGGYATYIADSG | 2803 | ABO77783.1 |
| 1921 | BORDETELLA PERTUSSIS | VLDGWYGVD | 2804 | ABO77783.1 |
| 1922 | BORDETELLA PERTUSSIS | VPASGAPAAVSVLG | 2805 | ABO77783.1 |
| 1923 | BORDETELLA PERTUSSIS | VRDEGGSSVLGRLG | 2806 | AB077783.1 |
| 1924 | BORDETELLA PERTUSSIS | VRTASGTTIKVSGR | 2807 | ABO77783.1 |
| 1925 | BORDETELLA PERTUSSIS | VSGGSLSAPHGNVI | 2808 | ABO77783.1 |
| 1926 | BORDETELLA PERTUSSIS | VSGRQAQGILLENP | 2809 | ABO77783.1 |
| 1927 | BORDETELLA PERTUSSIS | VTVQRSAIVDGGLH | 2810 | ABO77783.1 |
| 1928 | BORDETELLA PERTUSSIS | VVLRDTNVTAVPAS | 2811 | ABO77783.1 |
| 1929 | BORDETELLA PERTUSSIS | WNNQSIVKTGERQH | 2812 | ABO77783.1 |
| 1930 | BORDETELLA PERTUSSIS | WVRNSGSEPASANT | 2813 | ABO77783.1 |
| 1931 | BORDETELLA PERTUSSIS | WYAESNALSKRLGE | 2814 | ABO77783.1 |
| 1932 | BORDETELLA PERTUSSIS | YATYIADSGFYLDA | 2815 | ABO77783.1 |
| 1933 | BORDETELLA PERTUSSIS | YGVDVSGSS | 2816 | ABO77783.1 |
| 1934 | BORDETELLA PERTUSSIS | YGVDVSGSSVELAQ | 2817 | ABO77783.1 |
| 1935 | BORDETELLA PERTUSSIS | YLDATLRASRLEND | 2818 | ABO77783.1 |
| 1936 | BORDETELLA PERTUSSIS | YRVLPEPVKLTLTG | 2819 | ABO77783.1 |
| 1937 | BORDETELLA PERTUSSIS | VKAQNITNKRAALIEA | 2820 | AAA22974.1 |
| 1938 | BORDETELLA PERTUSSIS | YYSNVTATRLLSSTNS | 2821 | AAA83981.1 |
| 1939 | BORDETELLA PERTUSSIS | SPNLTDERAAQAGVT | 2822 | CPP72976.1 |
| 1940 | MEASLES MORBILLIVIRUS | SSRASDERAAHLPTS | 2823 | BAA33867.1 |
| 1941 | CORYNEBACTERIUM DIPHTHERIAE | QVVHNSYNRPAYSPG | 2824 | 1007216A |
| 1942 | MEASLES VIRUS STRAIN EDMONSTON-B | AEGGEIHEL | 2825 | AAF85692.1 |
| 1943 | MEASLES VIRUS STRAIN EDMONSTON-B | AENLISNGIGKY | 2826 | AAF85698.1 |

| NO. | DISEASE | EPITOPE AMINO ACID SEQUENCE | SEQ ID NO | ACCESS. NO. |
|---|---|---|---|---|
| 1944 | MEASLES VIRUS STRAIN EDMONSTON-B | AEVDGDVKL | 2827 | CAB43772.1 |
| 1945 | MEASLES VIRUS STRAIN EDMONSTON-B | AIYTAEIHK | 2828 | AAF85697.1 |
| 1946 | MEASLES VIRUS STRAIN EDMONSTON-B | APVFHMTNY | 2829 | CAB43772.1 |
| 1947 | MEASLES VIRUS STRAIN EDMONSTON-B | APVFHMTNYLEQPVSN | 2830 | AAR89413.1 |
| 1948 | MEASLES VIRUS STRAIN EDMONSTON-B | AQRLNEIY | 2831 | AAF85698.1 |
| 1949 | MEASLES VIRUS STRAIN EDMONSTON-B | ARVPHAYSL | 2832 | AAF85698.1 |
| 1950 | MEASLES VIRUS STRAIN EDMONSTON-B | AVRDLERAM | 2833 | P03424.1 |
| 1951 | MEASLES VIRUS STRAIN EDMONSTON-B | AVRDLERAMTTLK | 2834 | P03424.1 |
| 1952 | MEASLES VIRUS STRAIN EDMONSTON-B | DALLRLQAM | 2835 | Q89933.1 |
| 1935 | MEASLES VIRUS STRAIN EDMONSTON-B | DIKEKVINL | 2836 | AAF85698.1 |
| 1954 | MEASLES VIRUS STRAIN EDMONSTON-B | DQGLFKVL | 2837 | AAF85695.1 |
| 1955 | MEASLES VIRUS STRAIN EDMONSTON-B | DTGVDTRIW | 2838 | Q9EMA9.1 |
| 1956 | MEASLES VIRUS STRAIN EDMONSTON-B | EPIGSLAIEEAM | 2839 | AAF85692.1 |
| 1957 | MEASLES VIRUS STRAIN EDMONSTON-B | EPIRDALNAM | 2840 | P69354.1 |
| 1958 | MEASLES VIRUS STRAIN EDMONSTON-B | FPKLGKTL | 2841 | AAF85692.1 |
| 1959 | MEASLES VIRUS STRAIN EDMONSTON-B | FRSVNAVAF | 2842 | AAF85695.1 |
| 1960 | MEASLES VIRUS STRAIN EDMONSTON-B | GKIIDNTEQL | 2843 | AAF85695.1 |
| 1961 | MEASLES VIRUS STRAIN EDMONSTON-B | GLNEKLVFY | 2844 | AAF85695.1 |
| 1962 | MEASLES VIRUS STRAIN EDMONSTON-B | GMYGGTYLVEK | 2845 | AAC35876.2 |

| NO. | DISEASE | EPITOPE AMINO ACID SEQUENCE | SEQ ID NO | ACCESS. NO. |
| --- | --- | --- | --- | --- |
| 1963 | MEASLES VIRUS STRAIN EDMONSTON-B | GPPISLERLDVGTN | 2846 | P69354.1 |
| 1964 | MEASLES VIRUS STRAIN EDMONSTON-B | GPRQAQVSFL | 2847 | Q89933.1 |
| 1965 | MEASLES VIRUS STRAIN EDMONSTON-B | GRLVPQVRVID | 2848 | AAF85695.1 |
| 1966 | MEASLES VIRUS STRAIN EDMONSTON-B | GSAPISMGFR | 2849 | AAF85692.1 |
| 1967 | MEASLES VIRUS STRAIN EDMONSTON-B | HILAKSTAL | 2850 | AAF85698.1 |
| 1968 | MEASLES VIRUS STRAIN EDMONSTON-B | HYREVNLVY | 2851 | AAF85698.1 |
| 1969 | MEASLES VIRUS STRAIN EDMONSTON-B | IPPMKNLAL | 2852 | AAC35876.2 |
| 1970 | MEASLES VIRUS STRAIN EDMONSTON-B | IPYQGSGKGVSF | 2853 | CAB43772.1 |
| 1971 | MEASLES VIRUS STRAIN EDMONSTON-B | ISKESQHVY | 2854 | AAF85698.1 |
| 1972 | MEASLES VIRUS STRAIN EDMONSTON-B | IVSSHFFVY | 2855 | AAF85698.1 |
| 1973 | MEASLES VIRUS STRAIN EDMONSTON-B | KEIKETGRLF | 2856 | AAF85698.1 |
| 1974 | MEASLES VIRUS STRAIN EDMONSTON-B | KESQHVYYL | 2857 | AAF85698.1 |
| 1975 | MEASLES VIRUS STRAIN EDMONSTON-B | KIIDNTEQL | 2858 | AAF85695.1 |
| 1976 | MEASLES VIRUS STRAIN EDMONSTON-B | KKQINRQN | 2859 | AAA63285.1 |
| 1977 | MEASLES VIRUS STRAIN EDMONSTON-B | KKVDTNFIYQ | 2860 | AAF85698.1 |
| 1978 | MEASLES VIRUS STRAIN EDMONSTON-B | KLIDGFFPA | 2861 | AAF85698.1 |
| 1979 | MEASLES VIRUS STRAIN EDMONSTON-B | KPNLSSKRSEL | 2862 | BAB39848.1 |
| 1980 | MEASLES VIRUS STRAIN EDMONSTON-B | KVSPYLFTV | 2863 | AAR89413.1 |
| 1981 | MEASLES VIRUS STRAIN EDMONSTON-B | LETRTTNQFL | 2864 | CAB43772.1 |

| NO. | DISEASE | EPITOPE AMINO ACID SEQUENCE | SEQ ID NO | ACCESS. NO. |
|---|---|---|---|---|
| 1982 | MEASLES VIRUS STRAIN EDMONSTON-B | LLKEATEL | 2865 | AAF85695.1 |
| 1983 | MEASLES VIRUS STRAIN EDMONSTON-B | LLKKGNSLY | 2866 | AAF85698.1 |
| 1984 | MEASLES VIRUS STRAIN EDMONSTON-B | LPAPIGGMNY | 2867 | AAF85698.1 |
| 1985 | MEASLES VIRUS STRAIN EDMONSTON-B | MPEETLHQVM | 2868 | AAF85698.1 |
| 1986 | MEASLES VIRUS STRAIN EDMONSTON-B | PTTIRGQFS | 2869 | CAB43772.1 |
| 1987 | MEASLES VIRUS STRAIN EDMONSTON-B | QEISRHQALGY | 2870 | P03424.1 |
| 1988 | MEASLES VIRUS STRAIN EDMONSTON-B | RITHVDTESY | 2871 | P69354.1 |
| 1989 | MEASLES VIRUS STRAIN EDMONSTON-B | RPGLKPDL | 2872 | P69354.1 |
| 1990 | MEASLES VIRUS STRAIN EDMONSTON-B | RPIYGLEV | 2873 | AAF85698.1 |
| 1991 | MEASLES VIRUS STRAIN EDMONSTON-B | RQAGQEMILAV | 2874 | P69354.1 |
| 1992 | MEASLES VIRUS STRAIN EDMONSTON-B | SAVRIATVY | 2875 | AAF85698.1 |
| 1993 | MEASLES VIRUS STRAIN EDMONSTON-B | SLMPEETLHQV | 2876 | AAF85698.1 |
| 1994 | MEASLES VIRUS STRAIN EDMONSTON-B | SMIDLVTKF | 2877 | AAF85698.1 |
| 1995 | MEASLES VIRUS STRAIN EDMONSTON-B | SMLNSQAIDNLRA | 2878 | P69354.1 |
| 1996 | MEASLES VIRUS STRAIN EDMONSTON-B | SMYRVFEV | 2879 | CAB43772.1 |
| 1997 | MEASLES VIRUS STRAIN EDMONSTON-B | SQQGMFHAY | 2880 | AAF85698.1 |
| 1998 | MEASLES VIRUS STRAIN EDMONSTON-B | TDTPIVYNDRNLLD | 2881 | Q89933.1 |
| 1999 | MEASLES VIRUS STRAIN EDMONSTON-B | VIINDDQGLFKV | 2882 | AAF85695.1 |
| 2000 | MEASLES VIRUS STRAIN EDMONSTON-B | YESGVRIASL | 2883 | AAF85698.1 |

-continued

| NO. | DISEASE | EPITOPE AMINO ACID SEQUENCE | SEQ ID NO | ACCESS. NO. |
|---|---|---|---|---|
| 2001 | MEASLES VIRUS STRAIN EDMONSTON-B | YLKDKALA | 2884 | AAF85698.1 |
| 2002 | MEASLES VIRUS STRAIN EDMONSTON-B | YVYDHSGEAVK | 2885 | AAF85692.1 |
| 2003 | RUBELLA VIRUS | ARVIDPAAQSFTGVV | 2886 | BAA28178.1 |
| 2004 | RUBELLA VIRUS | SDRASARVIDPAAQS | 2887 | BAA28178.1 |
| 2005 | RUBELLA VIRUS | VPPGKFVTAALLNTP | 2888 | BAA28178.1 |
| 2006 | RUBELLA VIRUS | WVTPVIGSQARKCGL | 2889 | BAA28178.1 |
| 2007 | MUMPS RUBULAVIRUS | GTYRLIPNARANLTA | 400 | AGC97176.1 |

I. Delivery of Prime Editors

In another aspect, the present disclosure provides for the delivery of prime editors in vitro and in vivo using various strategies, including on separate vectors using split inteins and as well as direct delivery strategies of the ribonucleoprotein complex (i.e., the prime editor complexed to the PEgRNA and/or the second-site gRNA) using techniques such as electroporation, use of cationic lipid-mediated formulations, and induced endocytosis methods using receptor ligands fused to to the ribonucleotprotein complexes. Any such methods are contemplated herein.

Overview of Delivery Options

In some aspects, the invention provides methods comprising delivering one or more prime editor-encoding polynucleotides, such as or one or more vectors as described herein encoding one or more components of the prime editing system described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a prime editor as described herein in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a prime editor to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bihm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™) Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485, 054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In various embodiments, the PE constructs (including, the split-constructs) may be engineered for delivery in one or more rAAV vectors. An rAAV as related to any of the methods and compositions provided herein may be of any serotype including any derivative or pseudotype (e.g., 1, 2, 3, 4, 5, 6, 7, 8, 9, 10, 11, 12, 13, 2/1, 2/5, 2/8, 2/9, 3/1, 3/5, 3/8, or 3/9). An rAAV may comprise a genetic load (i.e., a recombinant nucleic acid vector that expresses a gene of interest, such as a whole or split PE fusion protein that is carried by the rAAV into a cell) that is to be delivered to a cell. An rAAV may be chimeric.

As used herein, the serotype of an rAAV refers to the serotype of the capsid proteins of the recombinant virus. Non-limiting examples of derivatives and pseudotypes include rAAV2/1, rAAV2/5, rAAV2/8, rAAV2/9, AAV2-AAV3 hybrid, AAVrh.10, AAVhu.14, AAV3a/3b, AAVrh32.33, AAV-HSC15, AAV-HSC17, AAVhu.37, AAVrh.8, CHt-P6, AAV2.5, AAV6.2, AAV2i8, AAV-HSC15/17, AAVM41, AAV9.45, AAV6(Y445F/Y731F), AAV2.5T, AAV-HAE1/2, AAV clone 32/83, AAVShH10, AAV2 (Y→F), AAV8 (Y733F), AAV2.15, AAV2.4, AAVM41, and AAVr3.45. A non-limiting example of derivatives and pseudotypes that have chimeric VP1 proteins is rAAV2/5-1VP1u, which has the genome of AAV2, capsid backbone of AAV5 and VP1u of AAV1. Other non-limiting example of derivatives and pseudotypes that have chimeric VP1 proteins are rAAV2/5-8VP1u, rAAV2/9-1VP1u, and rAAV2/9-8VP1u.

AAV derivatives/pseudotypes, and methods of producing such derivatives/pseudotypes are known in the art (see, e.g., Mol Ther. 2012 April; 20(4):699-708. doi: 10.1038/mt.2011.287. Epub 2012 January 24. The AAV vector toolkit: poised at the clinical crossroads. Asokan A1, Schaffer D V, Samulski R J.). Methods for producing and using pseudotyped rAAV vectors are known in the art (see, e.g., Duan et al., J. Virol., 75:7662-7671, 2001; Halbert et al., J. Virol., 74:1524-1532, 2000; Zolotukhin et al., Methods, 28:158-167, 2002; and Auricchio et al., Hum. Molec. Genet., 10:3075-3081, 2001).

Methods of making or packaging rAAV particles are known in the art and reagents are commercially available (see, e.g., Zolotukhin et al. Production and purification of serotype 1, 2, and 5 recombinant adeno-associated viral vectors. Methods 28 (2002) 158-167; and U.S. Patent Publication Numbers US20070015238 and US20120322861, which are incorporated herein by reference; and plasmids and kits available from ATCC and Cell Biolabs, Inc.). For example, a plasmid comprising a gene of interest may be combined with one or more helper plasmids, e.g., that contain a rep gene (e.g., encoding Rep78, Rep68, Rep52 and Rep40) and a cap gene (encoding VP1, VP2, and VP3, including a modified VP2 region as described herein), and transfected into a recombinant cells such that the rAAV particle can be packaged and subsequently purified.

Recombinant AAV may comprise a nucleic acid vector, which may comprise at a minimum: (a) one or more heterologous nucleic acid regions comprising a sequence encoding a protein or polypeptide of interest or an RNA of interest (e.g., a siRNA or microRNA), and (b) one or more regions comprising inverted terminal repeat (ITR) sequences (e.g., wild-type ITR sequences or engineered ITR sequences) flanking the one or more nucleic acid regions (e.g., heterologous nucleic acid regions). Herein, heterologous nucleic acid regions comprising a sequence encoding a protein of interest or RNA of interest are referred to as genes of interest.

Any one of the rAAV particles provided herein may have capsid proteins that have amino acids of different serotypes outside of the VP1u region. In some embodiments, the serotype of the backbone of the VP1 protein is different from the serotype of the ITRs and/or the Rep gene. In some embodiments, the serotype of the backbone of the VP1 capsid protein of a particle is the same as the serotype of the ITRs. In some embodiments, the serotype of the backbone of the VP1 capsid protein of a particle is the same as the serotype of the Rep gene. In some embodiments, capsid proteins of rAAV particles comprise amino acid mutations that result in improved transduction efficiency.

In some embodiments, the nucleic acid vector comprises one or more regions comprising a sequence that facilitates expression of the nucleic acid (e.g., the heterologous nucleic acid), e.g., expression control sequences operatively linked to the nucleic acid. Numerous such sequences are known in the art. Non-limiting examples of expression control sequences include promoters, insulators, silencers, response elements, introns, enhancers, initiation sites, termination signals, and poly(A) tails. Any combination of such control sequences is contemplated herein (e.g., a promoter and an enhancer).

Final AAV constructs may incorporate a sequence encoding the PEgRNA. In other embodiments, the AAV constructs may incorporate a sequence encoding the second-site nicking guide RNA. In still other embodiments, the AAV constructs may incorporate a sequence encoding the second-site nicking guide RNA and a sequence encoding the PEgRNA.

In various embodiments, the PEgRNAs and the second-site nicking guide RNAs can be expressed from an appropriate promoter, such as a human U6 (hU6) promoter, a mouse U6 (mU6) promoter, or other appropriate promoter. The PEgRNAs and the second-site nicking guide RNAs can be driven by the same promoters or different promoters.

In some embodiments, a rAAV constructs or the herein compositions are administered to a subject enterally. In some embodiments, a rAAV constructs or the herein compositions are administered to the subject parenterally. In some embodiments, a rAAV particle or the herein compositions are administered to a subject subcutaneously, intraocularly, intravitreally, subretinally, intravenously (IV), intracerebroventricularly, intramuscularly, intrathecally (IT), intracisternally, intraperitoneally, via inhalation, topically, or by direct injection to one or more cells, tissues, or organs. In some embodiments, a rAAV particle or the herein compositions are administered to the subject by injection into the hepatic artery or portal vein.

Split PE Vector-Based Strategies

In this aspect, the prime editors can be divided at a split site and provided as two halves of a whole/complete prime editor. The two halves can be delivered to cells (e.g., as expressed proteins or on separate expression vectors) and once in contact inside the cell, the two halves form the complete prime editor through the self-splicing action of the inteins on each prime editor half. Split intein sequences can be engineered into each of the halves of the encoded prime editor to facilitate their transplicing inside the cell and the concomitant restoration of the complete, functioning PE.

These split intein-based methods overcome several barriers to in vivo delivery. For example, the DNA encoding prime editors is larger than the rAAV packaging limit, and so requires special solutions. One such solution is formulating the editor fused to split intein pairs that are packaged into two separate rAAV particles that, when co-delivered to a cell, reconstitute the functional editor protein. Several other special considerations to account for the unique features of prime editing are described, including the optimization of second-site nicking targets and properly packaging prime editors into virus vectors, including lentiviruses and rAAV.

In this aspect, the prime editors can be divided at a split site and provided as two halves of a whole/complete prime editor. The two halves can be delivered to cells (e.g., as expressed proteins or on separate expression vectors) and once in contact inside the cell, the two halves form the complete prime editor through the self-splicing action of the inteins on each prime editor half. Split intein sequences can be engineered into each of the halves of the encoded prime editor to facilitate their transplicing inside the cell and the concomitant restoration of the complete, functioning PE.

FIG. 66 depicts depicts one embodiment of a prime editor being provided as two PE half proteins which regenerate as whole prime editor through the self-splicing action of the split-intein halves located at the end or beginning of each of the prime editor half proteins. As used herein, the term "PE N-terminal half" refers to the N-terminal half of a complete prime editor and which comprises the "N intein" at the C-terminal end of the PE N-terminal half (i.e., the N-terminal extein) of the complete prime editor. The "N intein" refers to the N-terminal half of a complete, fully-formed split-intein moiety. As used herein, the term "PE C-terminal half" refers to the C-terminal half of a complete prime editor and which comprises the "C intein" at the N-terminal end of the C-terminal half (i.e., the C-terminal extein) of a complete prime editor. When the two half proteins, i.e., the PE N-terminal half and the PE C-terminal half, come into contact with one another, e.g., within the cell, the N intein and the C intein undergo the simultaneous process of self-excision and the formation of a peptide bond between the C-terminal end of the PE N-terminal half and the N-terminal end of the PE C-terminal half to reform the complete prime editor protein comprising the complete napDNAbp domain (e.g., Cas9 nickase) and the RT domain. Although not shown in the drawing, the prime editor may also comprise additional sequences including NLS at the N-terminus and/or C-terminus, as well as amino acid linkers sequences joining each domain.

In various embodiments, the prime editors may be engineered as two half proteins (i.e., a PE N-terminal half and a PE C-terminal half) by "splitting" the whole prime editor as a "split site." The "split site" refers to the location of insertion of split intein sequences (i.e., the N intein and the C intein) between two adjacent amino acid residues in the prime editor. More specifically, the "split site" refers to the location of dividing the whole prime editor into two separate halves, wherein in each halve is fused at the split site to either the N intein or the C intein motifs. The split site can be at any suitable location in the prime editor fusion protein, but preferably the split site is located at a position that allows for the formation of two half proteins which are appropriately sized for delivery (e.g., by expression vector) and wherein the inteins, which are fused to each half protein at the split site termini, are available to sufficiently interact with one another when one half protein contacts the other half protein inside the cell.

In some embodiments, the split site is located in the napDNAbp domain. In other embodiments, the split site is located in the RT domain. In other embodiments, the split site is located in a linker that joins the napDNAbp domain and the RT domain.

In various embodiments, split site design requires finding sites to split and insert an N- and C-terminal intein that are both structurally permissive for purposes of packaging the two half prime editor domains into two different AAV genomes. Additionally, intein residues necessary for trans splicing can be incorporated by mutating residues at the N terminus of the C terminal extein or inserting residues that will leave an intein "scar."

Exemplary split configurations of split prime editors comprising either the SpCas9 nickase or the SaCas9 nickase are as follows.

S. PYOGENES PE, SPLIT AT LINKER, N TERMINAL
PORTION STRUCTURE: [N EXTEIN]-[N INTEIN]
MKRTADGSEFESPKKKRKVDKKYSIGLDIGTNSVGWAVITDEYKVPSKKF
KVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKY
PTIYHLRKKLVDSTDKADLRLIYLALAHMIKFRGHFLIEGDLNPDNSDVD
KLFIQLVQTYNQLFEENPINASGVDAKAILSARLSKSRRLENLIAQLPGE
KKNGLFGNLIALSLGLTPNFKSNFDLAEDAKLQLSKDTYDDDLDNLLAQI
GDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPF
LKDNREKIEKILTFRIPYYVGPLARGNSRFAWMTRKSEETITPWNFEEVV
DKGASAQSFIERMTNFDKNLPNEKVLPKHSLLYEYFTVYNELTKVKYVTE
GMRKPAFLSGEQKKAIVDLLFKTNRKVTVKQLKEDYFKKIECFDSVEISG
VEDRFNASLGTYHDLLKIIKDKDFLDNEENEDILEDIVLTLTLFEDREMI
EERLKTYAHLFDDKVMKQLKRRRYTGWGRLSRKLINGIRDKQSGKTILDF
LKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMK
RIEEGIKELGSQILKEHPVENTQLQNEKLYLYYLQNGRDMYVDQELDINR
LSDYDVDAIVPQSFLKDDSIDNKVLTRSDKNRGKSDNVPSEEVVKKMKNY
WRQLLNAKLITQRKFDNLTKAERGGLSELDKAGFIKRQLVETRQITKHVA
QILDSRMNTKYDENDKLIREVKVITLKSKLVSDFRKDFQFYKVREINNYH
HAHDAYLNAVVGTALIKKYPKLESEFVYGDYKVYDVRKMIAKSEQEIGKA
TAKYFFYSNIMNFFKTEITLANGEIRKRPLIETNGETGEIVWDKGRDFAT
VRKVLSMPQVNIVKKTEVQTGGFSKESILPKRNSDKLIARKKDWDPKKYG
GFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKY
VNFLYLASHYEKLKGSPEDNEQKQLFVEQHKHYLDEIIEQISEFSKRVIL
ADANLDKVLSAYNKHRDKPIREQAENIIHLFTLTNLGAPAAFKYFDTTID
RKRYTSTKEVLDATLIHQSITGLYETRIDLSQLGGDSGGSSGGSCLSYET
EILTVEYGLLPIGKIVEKRIECTVYSVDNNGNIYTQPVAQWHDRGEQEVF
EYCLEDGSLIRATKDHKFMTVDGQMLPIDEIFERELDLMRVDNLPNSGGS
KRTADGSEFEPKKKRKV(SEQ ID NO: 443)

KEY:
NLS (SEQ ID NO: 124, 125)
CAS9 (SEQ ID NO: 445)
LINKER (SEQ ID NO: 446)
NPUN INTEIN (SEQ ID NO: 447)

S. PYOGENES PE, SPLIT AT LINKER, C TERMINAL
PORTION STRUCTURE: [C INTEIN]-[C EXTEIN]
MKRTADGSEFESPKKKRKV*IKIATRKYLGKQNVYDIGVERDHNFALKNGF
IASN*CFNSGSETPGTSESATPESSGGSSGGSSTLNIEDEYRLHETSKEPD
VSLGSTWLSDFPQAWAETGGMGLAVRQAPLIIPLKATSTPVSIKQYPMSQ
EARLGIKPHIQRLLDQGILVPCQSPWNTPLLPVKKPGTNDYRPVQDLREV
NKRVEDIHPTVPNPYNLLSGLPPSHQWYTVLDLKDAFFCLRLHPTSQPLF
AFEWRDPEMGISGQLTWTRLPQGFKNSPTLFDEALHRDLADFRIQHPDLI
LLQYVDDLLLAATSELDCQQGTRALLQTLGNLGYRASAKKAQICQKQVKY
LGYLLKEGQRWLTEARKETVMGQPTPKTPRQLREFLGTAGFCRLWIPGFA
EMAAPLYPLTKTGTLFNWGPDQQKAYQEIKQALLTAPALGLPDLTKPFEL
FVDEKQGYAKGVLTQKLGPWRRPVAYLSKKLDPVAAGWPPCLRMVAAIAV
LTKDAGKLTMGQPLVILAPHAVEALVKQPPDRWLSNARMTHYQALLLDTD
RVQFGPVVALNPATLLPLPEEGLQHNCLDILAEAHGTRPDLTDQPLPDAD
HTWYTDGSSLWEGQRKAGAAVTTETEVIWAKALPAGTSAQRAELIALTQA
LKMAEGKKLNVYTDSRYAFATAHIHGEIYRRRGLLLTSEGKEIKNKDEILA
LLKALFLPKRLSIIHCPGHQKGHSAEARGNRMADQAARKAAITETPDTST
LLIENSSPSGGSKRTADGSEFEPKKKRKV(SEQ ID NO: 450)

KEY:
NLS (SEQ ID NO: 124, 125)
LINKER 1 (SEQ ID NO: 453)
LINKER 2 (SEQ ID NO: 174)
NPUC INTEIN (SEQ ID NO: 452)
RT (SEQ ID NO: 454)

S. AUREUS PE, SPLIT BETWEEN RESIDUES 740/741, N
TERMINAL PORTION STRUCTURE: [N EXTEIN]-[N INTEIN]
MKRTADGSEFESPKKKRKVGKRNYILGLAIGITSVGYGIIDYETRDVIDA
GVRLFKEANVENNEGRRSKRGARRLKRRRHRIQRVKKLLFDYNLLTDHS
ELSGINPYEARVKGLSQKLSEEEFSAALLHLAKRRGVHNVNEVEEDTGNE
LSTKEQISRNSKALEEKYVAELQLERLKKDGEVRGSINRFKTSDYVKEAK
QLLKVQKAYHQLDQSFIDTYIDLLETRRTYYEGPGEGSPFGWKDIKEWYE
MLMGHCTYFPEELRSVKYAYNADLYNALNDLNNLVITRDENEKLEYYEKF
QIIENVFKQKKKPTLKQIAKEILVNEEDIKGYRVTSTGKPEFTNLKVYHD
IKDITARKEIIENAELLDQIAKILTIYQSSEDIQEELTNLNSELTQEEIE
QISNLKGYTGTHNLSLKAINLILDELWHTNDNQIAIFNRLKLVPKKVDLS
QQKEIPTTLVDDFILSPVVKRSFIQSIKVINAIIKKYGLPNDIIIELARE
KNSKDAQKMINEMQKRNRQTNERIEEIIRTTGKENAKYLIEKIKLHDMQE
GKCLYSLEAIPLEDLLNNPFNYEVDHIIPRSVSFDNSFNNKVLVKQEENS
KKGNRTPFQYLSSSDSKISYETFKKHILNLAKGKGRISKTKKEYLLEERD
INRFSVQKDFINRNLVDTRYATRGLMNLLRSYFRVNNLDVKVKSINGGFT
SFLRRKWKFKKERNKGYKHHAEDALIIANADFIFKEWKKLDKAKKVMENQ
MFEEKQAECLSYETEILTVEYGLLPIGKIVEKRIECTVYSVDNNGNIYTQ
PVAQWHDRGEQEVFEYCLEDGSLIRATKDHKFMTVDGQMLPIDEIFEREL
DLMRVDNLPNSGGSKRTADGSEFEPKKKRKV(SEQ ID NO: 458)

KEY:
NLS (SEQ ID NO: 124, 125)
CAS9 (SEQ ID NO: 460)
LINKER (SEQ ID NO: 174)
NPUN INTEIN (SEQ ID NO: 462)

S. AUREUS PE, SPLIT BETWEEN RESIDUES 740/741, C
TERMINAL PORTION STRUCTURE: [C INTEIN]-[C EXTEIN]
MKRTADGSEFESPKKKRKV*IKIATRKYLGKQNVYDIGVERDHNFALKNGF

-continued

IASN*CFNEIETEQEYKEIFITPHQIKHIKDFKDYKYSHRVDKKPNRKLIN*

DTLYSTRKDDKGNTLIVNNLNGLYDKDNDKLKKLINKSPEKLLMYHHDPQ

TYQKLKLIMEQYGDEKNPLYKYYEETGNYLTKYSKKDNGPVIKKIKYYGN

KLNAHLDITDDYPNSRNKVVKLSLKPYRFDVYLDNGVYKFVTVKNLDVIK

KENYYEVNSKCYEEAKKLKKISNQAEFIASFYKNDLIKINGELYRVIGVN

NDLLNRIEVNMIDITYREYLENMNDKRPPHIIKTIASKTQSIKKYSTDIL

GNLYEVKSKKHPQIIKKGSGGSSGGSSGSETPGTSESATPESSGGSSGGS

*S*TLNIEDEYRLHETSKEPDVSLGSTWLSDFPQAWAETGGMGLAVROAPLI

*IPLKATSTPVSIKOYPMSOEARLGIKPHIORLLDOGILVPCOSPWNTPLL*

*PVKKPGTNDYRPVQDLREVNKRVEDIHPTVPNPYNLLSGLPPSHQWYTVL*

*DLKDAFFCLRLHPTSOPLFAFEWRDPEMGISGOLTWTRLPOGFKNSPTLF*

*DEALHRDLADFRIOHPDLILLQYVDDLLLAATSELDCQQGTRALLQTLGN*

*LGYRASAKKAQICQKQVKYLGYLLKEGQRWLTEARKETVMGQPTPKTPRQ*

*LREFLGTAGFCRLWIPGFAEMAAPLYPLTKTGTLFNWGPDOOKAYOEIWA*

*LLTAPALGLPDLTKPFELFVDEKOGYAKGVLTOKLGPWRRPVAYLSKKLD*

*PVAAGWPPCLRMVAAIAVLTKDAGKLTMGQPLVILAPHAVEALVKQPPDR*

*WLSNARMTHYOALLLDTDRWFGPVVALNPATLLPLPEEGLOHNCLDILAE*

*AHGTRPDLTDQPLPDADHTWYTDGSSLLQEGQRKAGAAVTTETEVIWAKA*

*LPAGTSAQRAELIALIVALKMAEGKKLNVYTDSRYAFATAHIHGEIYRRR*

*GLLTSEGKEIKNKDEILALLKALFLPKRLSIIHCPGHQKGHSAEARGNRM*

*ADQAARKAAITETPDTSTLLIENSSP*SGGS*KRTADGSEFEPKKKRKV*

(SEQ ID NO: 465)

KEY:
NLS (SEQ ID NO: 124, 125)
CAS9 (SEQ ID NO: 467)
LINKER 1 (SEQ ID NO: 127)
LINKER 2 (SEQ ID NO: 174)
NPUC INTEIN (SEQ ID NO: 452)
RT (SEQ ID NO: 471)

In various embodiments, using SpCas9 nickase (SEQ ID NO: 18, 1368 amino acids) as an example, the split can between between any two amino acids between 1 and 1368. Preferred splits, however, will be located between the central region of the protein, e.g., from amino acids 50-1250, or from 100-1200, or from 150-1150, or from 200-1100, or from 250-1050, or from 300-1000, or from 350-950, or from 400-900, or from 450-850, or from 500-800, or from 550-750, or from 600-700 of SEQ ID NO: 18. In specific exemplary embodiments, the split site may be between 740/741, or 801/802, or 1010/1011, or 1041/1042. In other embodiments the split site may be between 1/2, 2/3, 3/4, 4/5, 5/6, 6/7, 7/8, 8/9, 9/10, 10/11, 12/13, 14/15, 15/16, 17/18, 19/20, 20/21, 21/22, 22/23, 23/24, 24/25, 25/26, 26/27, 27/28, 28/29, 29/30, 30/31, 31/32, 32/33, 33/34, 34/35, 35/36, 36/37, 38/39, 39/40, 41/42, 42/43, 43/44, 44/45, 45/46, 46/47, 47/48, 48/49, 49/50, 51/52, 52/53, 53/54, 54/55, 55/56, 56/57, 57/58, 58/59, 59/60, 61/62, 62/63, 63/64, 64/65, 65/66, 66/67, 67/68, 68/69, 69/70, 71/72, 72/73, 73/74, 74/75, 75/76, 76/77, 77/78, 78/79, 79/80, 81/82, 82/83, 83/84, 84/85, 85/86, 86/87, 87/88, 88/89, 89/90, or between any two pairs of adjacent residues between 90-100, 100-150, 150-200, 200-250, 250-300, 300-350, 350-400, 450-500, 500-550, 550-600, 600-650, 650-700, 700-750, 750-800, 800-850, 850-900, 900-950, 950-1000, 1000-1050, 1050-1100, 1100-1150, 1150-1200, 1200-1250, 1250-1300, 1300-1350, and 1350-1368, relative to SpCas9 of SEQ ID NO: 18, at between any two corresponding residues in an amino acid sequence having at least 80%, 85%, 90%, 95%, 98%, 99%, or 99.9% sequence identity with SEQ ID NO: 18, or between any two corresponding residues in a variant or equivalent of SpCas9 of any of amino acid sequences SEQ ID NOs. 19-88, or an amino acid sequence having at least 80%, 85%, 90%, 95%, 98%, 99%, or 99.9% sequence identity with any of SEQ ID NOs: 19-88.

In various embodiments, the split intein sequences can be engineered by from the following intein sequences.

| NAME | SEQUENCE OF LIGAND-DEPENDENT INTEIN |
|---|---|
| 2-4 INTEIN: | CLAEGTRIFDPVTGTTHRIEDVVDGRKPIHVVAAAKDGTLLARPVV SWFDQGTRDVIGLRIAGGAIVWATPDHKVLTEYGWRAAGELRKGD RVAGPGGSGNSLALSLTADQMVSALLDAEPPILYSEYDPTSPFSEAS MMGLLTNLADRELVHMINWAKRVPGFVDLTLHDQAHLLECAWLEI LMIGLVWRSMEHPGKLLFAPNLLLDRNQGKCVEGMVEIFDMLLAT SSRFRMMNLQGEEFVCLKSIILLNSGVYTFLSSTLKSLEEKDHIHRA LDKITDTLIHLMAKAGLTLQQQHQRLAQLLLILSHIRHMSNKGMEH LYSMKYKNVVPLYDLLLEMLDAHRLHAGGSGASRVQAFADALDD KFLHDMLAEELRYSVIREVLPTRRARTFDLEVEELHTLVAEGVVVH NC (SEQ ID NO: 472) |
| 3-2 INTEIN | CLAEGTRIFDPVTGTTHRIEDVVDGRKPIHVVAVAKDGTLLARPVVS WFDQGTRDVIGLRIAGGAIVWATPDHKVLTEYGWRAAGELRKGDR VAGPGGSGNSLALSLTADQMVSALLDAEPPILYSEYDPTSPFSEASM MGLLTNLADRELVHMINWAKRVPGFVDLTLHDQAHLLECAWLEIL MIGLVWRSMEHPGKLLFAPNLLLDRNQGKCVEGMVEIFDMLLATS SRFRMMNLQGEEFVCLKSIILLNSGVYTFLSSTLKSLEEKDHIHRAL DKITDTLIHLMAKAGLTLQQQHQRLAQLLLILSHIRHMSNKGMEHL YSMKYTNVVPLYDLLLEMLDAHRLHAGGSGASRVQAFADALDDK FLHDMLAEELRYSVIREVLPTRRARTFDLEVEELHTLVAEGVVVHNC (SEQ ID NO: 473) |
| 30R3-1 INTEIN | CLAEGTRIFDPVTGTTHRIEDVVDGRKPIHVVAAAKDGTLLARPVV SWFDQGTRDVIGLRIAGGATVWATPDHKVLTEYGWRAAGELRKG DRVAGPGGSGNSLALSLTADQMVSALLDAEPPIPYSEYDPTSPFSEA SMMGLLTNLADRELVHMINWAKRVPGFVDLTLHDQAHLLECAWL EILMIGLVWRSMEHPGKLLFAPNLLLDRNQGKCVEGMVEIFDMLL |

| NAME | SEQUENCE OF LIGAND-DEPENDENT INTEIN |
|---|---|
| | ATSSRFRMMNLQGEEFVCLKSIILLNSGVYTFLSSTLKSLEEKDHIH<br>RALDKITDTLIHLMAKAGLTLQQQHQRLAQLLLILSHIRHMSNKGM<br>EHLYSMKYKNVVPLYDLLLEMLDAHRLHAGGSGASRVQAFADAL<br>DDKFLHDMLAEGLRYSVIREVLPTRRARTFDLEVEELHTLVAEGVV<br>VHNC (SEQ ID NO: 474) |
| 30R3-2 INTEIN | CLAEGTRIFDPVTGTTHRIEDVVDGRKPIHVVAAAKDGTLLARPVV<br>SWFDQGTRDVIGLRIAGGATVWATPDHKVLTEYGWRAAGELRKG<br>DRVAGPGGSGNSLALSLTADQMVSALLDAEPPILYSEYDPTSPFSEA<br>SMMGLLTNLADRELVHMINWAKRVPGFVDLTLHDQAHLLECAWL<br>EILMIGLVWRSMEHPGKLLFAPNLLLDRNQGKCVEGMVEIFDMLL<br>ATSSRFRMMNLQGEEFVCLKSIILLNSGVYTFLSSTLKSLEEKDHIH<br>RALDKITDTLIHLMAKAGLTLQQQHQRLAQLLLILSHIRHMSNKGM<br>EHLYSMKYKNVVPLYDLLLEMLDAHRLHAGGSGASRVQAFADAL<br>DDKFLHDMLAEELRYSVIREVLPTRRARTFDLEVEELHTLVAEGVV<br>VHNC (SEQ ID NO: 475) |
| 30R3-3 INTEIN | CLAEGTRIFDPVTGTTHRIEDVVDGRKPIHVVAAAKDGTLLARPVV<br>SWFDQGTRDVIGLRIAGGATVWATPDHKVLTEYGWRAAGELRKG<br>DRVAGPGGSGNSLALSLTADQMVSALLDAEPPIPYSEYDPTSPFSEA<br>SMMGLLTNLADRELVHMINWAKRVPGFVDLTLHDQAHLLECAWL<br>EILMIGLVWRSMEHPGKLLFAPNLLLDRNQGKCVEGMVEIFDMLL<br>ATSSRFRMMNLQGEEFVCLKSIILLNSGVYTFLSSTLKSLEEKDHIH<br>RALDKITDTLIHLMAKAGLTLQQQHQRLAQLLLILSHIRHMSNKGM<br>EHLYSMKYKNVVPLYDLLLEMLDAHRLHAGGSGASRVQAFADAL<br>DDKFLHDMLAEELRYSVIREVLPTRRARTFDLEVEELHTLVAEGVV<br>VHNC (SEQ ID NO: 476) |
| 37R3-1 INTEIN | CLAEGTRIFDPVTGTTHRIEDVVDGRKPIHVVAAAKDGTLLARPVV<br>SWFDQGTRDVIGLRIAGGATVWATPDHKVLTEYGWRAAGELRKG<br>DRVAGPGGSGNSLALSLTADQMVSALLDAEPPILYSEYNPTSPFSEA<br>SMMGLLTNLADRELVHMINWAKRVPGFVDLTLHDQAHLLERAWL<br>EILMIGLVWRSMEHPGKLLFAPNLLLDRNQGKCVEGMVEIFDMLL<br>ATSSRFRMMNLQGEEFVCLKSIILLNSGVYTFLSSTLKSLEEKDHIH<br>RALDKITDTLIHLMAKAGLTLQQQHQRLAQLLLILSHIRHMSNKGM<br>EHLYSMKYKNVVPLYDLLLEMLDAHRLHAGGSGASRVQAFADAL<br>DDKFLHDMLAEGLRYSVIREVLPTRRARTFDLEVEELHTLVAEGVV<br>VHNC ((SEQ ID NO: 477) |
| 37R3-2 INTEIN | CLAEGTRIFDPVTGTTHRIEDVVDGRKPIHVVAAAKDGTLLARPVV<br>SWFDQGTRDVIGLRIAGGAIVWATPDHKVLTEYGWRAAGELRKGD<br>RVAGPGGSGNSLALSLTADQMVSALLDAEPPILYSEYDPTSPFSEAS<br>MMGLLTNLADRELVHMINWAKRVPGFVDLTLHDQAHLLERAWLEI<br>LMIGLVWRSMEHPGKLLFAPNLLLDRNQGKCVEGMVEIFDMLLAT<br>SSRFRMMNLQGEEFVCLKSIILLNSGVYTFLSSTLKSLEEKDHIHRA<br>LDKITDTLIHLMAKAGLTLQQQHQRLAQLLLILSHIRHMSNKGMEH<br>LYSMKYKNVVPLYDLLLEMLDAHRLHAGGSGASRVQAFADALDD<br>KFLHDMLAEGLRYSVIREVLPTRRARTFDLEVEELHTLVAEGVVVH<br>NC (SEQ ID NO: 478) |
| 37R3-3 INTEIN | CLAEGTRIFDPVTGTTHRIEDVVDGRKPIHVVAVAKDGTLLARPVVS<br>WFDQGTRDVIGLRIAGGATVWATPDHKVLTEYGWRAAGELRKGD<br>RVAGPGGSGNSLALSLTADQMVSALLDAEPPILYSEYDPTSPFSEAS<br>MMGLLTNLADRELVHMINWAKRVPGFVDLTLHDQAHLLERAWLEI<br>LMIGLVWRSMEHPGKLLFAPNLLLDRNQGKCVEGMVEIFDMLLAT<br>SSRFRMMNLQGEEFVCLKSIILLNSGVYTFLSSTLKSLEEKDHIHRA<br>LDKITDTLIHLMAKAGLTLQQQHQRLAQLLLILSHIRHMSNKGMEH<br>LYSMKYKNVVPLYDLLLEMLDAHRLHAGGSGASRVQAFADALDD<br>KFLHDMLAEELRYSVIREVLPTRRARTFDLEVEELHTLVAEGVVVH<br>NC (SEQ ID NO: 479) |

In various other embodiments, the split intein sequences can be used as follows:

| INTEIN-N | INTEIN-C |
|---|---|
| NPU-N<br>CLSYETEILTVEYGLLPIGKIVEK<br>RIECTVYSVDNNGNIYTQPVAQWH<br>DRGEQEVFEYCLEDGSLIRATKDH<br>KFMTVDGQMLPIDEIFERELDLMR<br>VDNLPNSGGS<br>(SEQ ID NO: 447) | NPU-C<br>IKIATRKYLGKQNVYDIGVERD<br>HNFALKNGFIASN<br>(SEQ ID NO: 452) |

In various embodiments, the split inteins can be used to separately deliver separate portions of a complete PE fusion protein to a cell, which upon expression in a cell, become reconstituted as a complete PE fusion protein through the trans splicing.

In some embodiments, the disclosure provides a method of delivering a PE fusion protein to a cell, comprising:
(a) constructing a first expression vector encoding an N-terminal fragment of the PE fusion protein fused to a first split intein sequence;
(b) constructing a second expression vector encoding a C-terminal fragment of the PE fusion protein fused to a second split intein sequence;

(c) delivering the first and second expression vectors to a cell, wherein the N-terminal and C-terminal fragment are reconstituted as the PE fusion protein in the cell as a result of trans splicing activity causing self-excision of the first and second split intein sequences.

The split site in some embodiments can be anywhere in the prime editor fusion, including the napDNAbp domain, the linker, or the reverse transcriptase domain.

In other embodiments, the split site is in the napDNAbp domain.

In still other embodiments, the split site is in the reverse transcriptase or polymerase domain.

In yet other embodiments, the split site is in the linker.

In various embodiments, the present disclosure provides prime editors comprising a napDNAbp (e.g., a Cas9 domain) and a reverse transcriptase wherein one or both of the napDNAbp and/or the reverse transcriptase comprise an intein, for example, a ligand-dependent intein. Typically the intein is a ligand-dependent intein which exhibits no or minimal protein splicing activity in the absence of ligand (e.g., small molecules such as 4-hydroxytamoxifen, peptides, proteins, polynucleotides, amino acids, and nucleotides). Ligand-dependent inteins are known, and include those described in U.S. patent application U.S. Ser. No. 14/004,280, published as U.S. 2014/0065711 A1, the entire contents of which are incorporated herein by reference. In addition, use of split-Cas9 architecture In some embodiments, the intein comprises an amino acid sequence selected from the group consisting of SEQ ID NOs: 8-15, 447, 452, 462, and 472-479.

In various embodiments, the napDNAbp domains are smaller-sized napDNAbp domains as compared to the canonical SpCas9 domain of SEQ ID NO: 18.

The canonical SpCas9 protein is 1368 amino acids in length and has a predicted molecular weight of 158 kilodaltons. The term "small-sized Cas9 variant", as used herein, refers to any Cas9 variant—naturally occurring, engineered, or otherwise—that is less than at least 1300 amino acids, or at least less than 1290 amino acids, or than less than 1280 amino acids, or less than 1270 amino acid, or less than 1260 amino acid, or less than 1250 amino acids, or less than 1240 amino acids, or less than 1230 amino acids, or less than 1220 amino acids, or less than 1210 amino acids, or less than 1200 amino acids, or less than 1190 amino acids, or less than 1180 amino acids, or less than 1170 amino acids, or less than 1160 amino acids, or less than 1150 amino acids, or less than 1140 amino acids, or less than 1130 amino acids, or less than 1120 amino acids, or less than 1110 amino acids, or less than 1100 amino acids, or less than 1050 amino acids, or less than 1000 amino acids, or less than 950 amino acids, or less than 900 amino acids, or less than 850 amino acids, or less than 800 amino acids, or less than 750 amino acids, or less than 700 amino acids, or less than 650 amino acids, or less than 600 amino acids, or less than 550 amino acids, or less than 500 amino acids, but at least larger than about 400 amino acids and retaining the required functions of the Cas9 protein.

In one embodiment, as depicted in Example 20, the specification embraces the following split-intein PE contructs, which are split between residues 1024 and 1025 of the canonical SpCas9 (SEQ ID NO: 18) (or which may be referred to as residues 1023 and 1024, respectively, relative to a Met-minus SEQ ID NO: 18).

First, the amino acid sequence of SEQ ID NO: 18 is shown as follows, indicating the location of the split site between 1024 ("K") and 1025 ("S") residues:

| Description | Sequence | SEQ ID NO: |
|---|---|---|
| SpCas9 Streptococcus pyogenes M1 SwissProt Accession No. Q99ZW2 Wild type | MDKKYSIGLDIGTNSVGWAVITDEYKVPSKKFKVLGN TDRHSIKKNLIGALLFDSGETAEATRLKRTARRRYTRR KNRICYLQEIFSNEMAKVDDSFFHRLEESFLVEEDKKH ERHPIFGNIVDEVAYHEKYPTIYHLRKKLVDSTDKADL RLIYLALAHMIKFRGHFLIEGDLNPDNSDVDKLFIQLVQ TYNQLFEENPINASGVDAKAILSARLSKSRRLENLIAQL PGEKKNGLFGNLIALSLGLTPNFKSNFDLAEDAKLQLS KDTYDDDLDNLLAQIGDQYADLFLAAKNLSDAILLSDI LRVNTEITKAPLSASMIKRYDEHHQDLTLLKALVRQQL PEKYKEIFFDQSKNGYAGYIDGGASQEEFYKFIKPILEK MDGTEELLVKLNREDLLRKQRTFDNGSIPHQIHLGELH AILRRQEDFYPFLKDNREKIEKILTFRIPYYVGPLARGN SRFAWMTRKSEETITPWNFEEVVDKGASAQSFIERMTN FDKNLPNEKVLPKHSLLYEYFTVYNELTKVKYVTEGM RKPAFLSGEQKKAIVDLLFKTNRKVTVKQLKEDYFKKI ECFDSVEISGVEDRFNASLGTYHDLLKIIKDKDFLDNEE NEDILEDIVLTLTLFEDREMIEERLKTYAHLFDDKVMK QLKRRRYTGWGRLSRKLINGIRDKQSGKTILDFLKSDG FANRNFMQLIHDDSLTFKEDIQKAQVSGQGDSLHEHIA NLAGSPAIKKGILQTVKVVDELVKVMGRHKPENIVIEM ARENQTTQKGQKNSRERMKRIEEGIKELGSQILKEHPV ENTQLQNEKLYLYYLQNGRDMYVDQELDINRLSDYD VDHIVPQSFLKDDSIDNKVLTRSDKNRGKSDNVPSEEV VKKMKNYWRQLLNAKLITQRKFDNLTKAERGGLSEL DKAGFIKRQLVETRQITKHVAQILDSRMNTKYDENDK LIREVKVITLKSKLVSDFRKDFQFYKVREINNYHHAHD AYLNAVVGTALIKKYPKLESEFVYGDYKVYDVRKMIA KSEQEIGKATAKYFFYSNIMNFFKTEITLANGEIRKRPLI ETNGETGEIVWDKGRDFATVRKVLSMPQVNIVKKTEV QTGGFSKESILPKRNSDKLIARKKDWDPKKYGGFDSPT VAYSVLVVAKVEKGKSKKLKSVKELLGITIMERSSFEK NPIDFLEAKGYKEVKKDLIIKLPKYSLFELENGRKRML ASAGELQKGNELALPSKYVNFLYLASHYEKLKGSPED NEQKQLFVEQHKHYLDEIIEQISEFSKRVILADANLDKV LSAYNKHRDKPIREQAENIIHLFTLTNLGAPAAFKYFDT TIDRKRYTSTKEVLDATLIHQSITGLYETRIDLSQLGGD | SEQ ID NO: 18, indicated with split site 1024/1025 in bold The M at position 1 is not necessarily present in the PE fusion protein in certain embodiments. Thus, the numbering of the split site is 1023/1024 in the case that the amino acid sequence excludes Met at position 1. |

In this configuration, the amino acid sequence of N-terminal half (amino acids 1-1024) is as follows:

(SEQ ID NO: 3877)
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDAIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAK.

In this configuration, the amino acid sequence of N-terminal half (amino acids 1-1023) (where the protein is Met-minus at position 1) is as follows:

(SEQ ID NO: 3878)
DKKYSIGLDIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDAIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAK.

In this configuration, the amino acid sequence of C-terminal half (amino acids 1024-1368 (or counted as amino acids 1023-1367 in a Met-minus Cas9) is as follows:

(SEQ ID NO: 3879)
<u>S</u>EQEIGKATAKYFFYSNIMNFFKTEITLANGEIRKRPLIETNGETGEIVW
DKGRDFATVRKVLSMPQVNIVKKTEVQTGGFSKESILPKRNSDKLIARKK
DWDPKKYGGFDSPTVAYSVLVVAKVEKGKSKKLKSVKELLGITIMERSSF
EKNPIDFLEAKGYKEVKKDLIIKLPKYSLFELENGRKRMLASAGELQKGN
ELALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAAF
KYFDTTIDRKRYTSTKEVLDATLIHQSITGLYETRIDLSQLGGD.

As shown in Example 20, the PE2 (which is based on SpCas9 of SEQ ID NO: 18) construct was split at position 1023/1024 (relative to a Met-minus SEQ ID NO: 18) into two separate constructs, as follows:

SpPE2 Split at 1023/1024 N Terminal Half (SEQ ID NO: 3875)
<u>MKRTADGSEFESPKKKRK</u>VDKKYSIGLDIGTNSVGWAVITDEYKVPSKK
FKVLGNTDRHSIKKNLIGALLFDSGETAEATRLKRTARRRYTRRKNRIC
YLQEIFSNEMAKVDDSFFHRLEESFLVEEDKKHERHPIFGNIVDEVAYH
EKPTIYHLRKKLVDSTDKADLRLIYLALAHMIKFRGHFLIEGDLNPDN
SDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLD
NLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYK
FIKPILEKMDGTEELLVKLNREDLLRKQRTFDNGSIPHQIHLGELHAIL
RRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVY
NELTKVKYVTEGMRKPAFLSGEQKKAIVDLLFKTNRKVTVKQLKEDYFK
KIECFDSVEISGVEDRFNASLGTYHDLLKIIKDKDFLDNEENEDILEDI
VLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQG
DSLHEHIANLAGSPAIKKGILQTVKVVDELVKVMGRHKPENIVIEMARE
NQTTQKGQKNSRERMKRIEEGIKELGSQILKEHPVENTQLQNEKLYLYY
LQNGRDMYVDQELDINRLSDYDVDAIVPQSFLKDDSIDNKVLTRSDKNR -continued
GKSDNVPSEEVVKKMKNYWRQLLNAKLITQRKFDNLTKAERGGLSELDK

AGFIKRQLVETRQITKHVAQILDSRMNTKYDENDKLIREVKVITLKSKL

VSDFRKDFQFYKVREINNYHHAHDAYLNAVVGTALIKKYPKLESEFVYG

DYKVYDVRKMIA*KCLSYETEILTVEYGLLPIGKIVEKRIECT*

*VXSVDNNGNIYTQPVAQW* *HDRGEQEVEEYCLEDGSLIRATKDHKEMTVD*

*GQMLPIDEIEERELDLMRVDNLPNSGGS*KRTADGSEFEPKKKRKV
Key:

NLS, Cas9, Mutaledresidues, Linker, *NpuN intein*, NpuC intein,
RT

SpPE2 Split at 1023/1024 C Terminal Half (SEQ ID NO: 3876)
MKRTADGSEFESPKKKRKV*IKIATRKYLGKQNVYDIGVERDHNFALKNGF*

*IASN*CFNEIGKATAKYFFYSNIMNFFKTEITLANGEIRKRPLIETNGETG

EIVWDKGRDFATVRKVLSMPQVNIVKKTEVQTGGFSKESILPKRNSDKLI

ARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGEL

QKGNELALPSKYVNFLYLASHYEKLKGSPEDNEQKQLFVEQHKHYLDEII

EQISEFSKRVILADANLDKVLSAYNKHRDKPIREQAENIIHLFTLTNLGA

PAAFKYFDTTIDRKRYTSTKEVLDATLIHQSITGLYETRIDLSQLGGISG

GSSGGSS GSETPGTSESATPESSGGSSGGSSTLNIEDEYRLHETSKEPDV

SLGSTWLSDFPQAWAETGGMGLAVRQAPLIIPLKATSTPVSIKQYPMSQE

ARLGIKPHIQRLLDQGILVPCQSPWNTPLLPVKKPGTNDYRPVQDLREVN

KRVEDIHPTVPNPYNLLSGLPPSHQWYTVLDLKDAFFCLRLHPTSQPLFA

FEWRDPEMGISGQLTWTRLPQGFKNSPTLFNEALHRDLADFRIQHPDLIL

LQYVDDLLLAATSELDCQQGTRALLQTLGNLGYRASAKKAQICQKQVKYL

GYLLKEGQRWLTEARKETVMGQPTPKTPRQLREFLGKAGFCRLFIPGFAE

MAAPLYPLTKPGTLFNWGPDQQKAYQEIKQALLTAPALGLPDLTKPFELF

VDEKQGYAKGVLTQKLGPWRRPVAYLSKKLDPVAAGWPPCLRMVAAIAVL

TKDAGKLTMGQPLVILAPHAVEALVKQPPDRWLSNARMTHYQALLLDTDR

VQFGPVVALNPATLLPLPEEGLQHNCLDILAEAHGTRPDLTDQPLPDADH

TWYTDGSSLLQEGQRKAGAAVTTETEVIWAKALPAGTSAQRAELIALTQA

LKMAEGKKLNVYTDSRYAFATAHIHGEIYRRRGWLTSEGKEIKNKDEILA

LLKALFLPKRLSIIHCPGHQKGHSAEARGNRMADQAARKAAITETPDTST

LLIENSSPSGGS*KRTADGSEFEPKKKRK*
Key:

+euns NLS, Cas9, Mutaledresidues, Linker, *NpuN intein*, NpuC
intein, RT

The present disclosure also contemplates methods of delivering split-intein prime editors to cells and/or treating cells with split-intein prime editors.

In some embodiments, the disclosure provides a method of delivering a PE fusion protein to a cell, comprising:
(a) constructing a first expression vector encoding an N-terminal fragment of the PE fusion protein fused to a first split intein sequence;
(b) constructing a second expression vector encoding a C-terminal fragment of the PE fusion protein fused to a second split intein sequence;
(c) delivering the first and second expression vectors to a cell, wherein the N-terminal and C-terminal fragment are reconstituted as the PE fusion protein in the cell as a result of trans splicing activity causing self-excision of the first and second split intein sequences.

In certain embodiments, the N-terminal fragment of the PE fusion protein fused to a first split intein sequence is SEQ ID NO: 3875, or an amino acid sequence having at least 80%, at least 85%, at least 90%, at least 95%, at least 98%, or at least 99.9% sequence identity with SEQ ID NO: 3875.

In other embodiments, the C-terminal fragment of the PE fusion protein fused to a first split intein sequence is SEQ ID NO: 3876, or an amino acid sequence having at least 80%, at least 85%, at least 90%, at least 95%, at least 98%, or at least 99.9% sequence identity with SEQ ID NO: 3876.

In other embodiments, the disclosure provides a method of editing a target DNA sequence within a cell, comprising:
(a) constructing a first expression vector encoding an N-terminal fragment of the PE fusion protein fused to a first split intein sequence;
(b) constructing a second expression vector encoding a C-terminal fragment of the PE fusion protein fused to a second split intein sequence;
(c) delivering the first and second expression vectors to a cell, wherein the N-terminal and C-terminal fragment are reconstituted as the PE fusion protein in the cell as a result of trans splicing activity causing self-excision of the first and second split intein sequences.

In certain embodiments, the N-terminal fragment of the PE fusion protein fused to a first split intein sequence is SEQ ID NO: 3875, or an amino acid sequence having at least 80%, at least 85%, at least 90%, at least 95%, at least 98%, or at least 99.9% sequence identity with SEQ ID NO: 3875.

In other embodiments, the C-terminal fragment of the PE fusion protein fused to a first split intein sequence is SEQ ID NO: 3876, or an amino acid sequence having at least 80%, at least 85%, at least 90%, at least 95%, at least 98%, or at least 99.9% sequence identity with SEQ ID NO: 3876.

Delivery of PE Ribonucleoprotein Complexes

In this aspect, the prime editors may be delivered by non-viral delivery strategies involving delivery of a prime editor complexed with a PEgRNA (i.e., a PE ribonucleoprotein complex) by various methods, including electroporation and lipid nanoparticles. Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-

654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

Additional reference may be made to the following references that discuss approaches for non-viral delivery of ribonucleoprotein complexes, each of which are incorporated herein by reference.

Chen, Sean, et al. "Highly efficient mouse genome editing by CRISPR ribonucleoprotein electroporation of zygotes." *Journal of Biological Chemistry* (2016): jbc-M116. PubMed Zuris, John A., et al. "Cationic lipid-mediated delivery of proteins enables efficient protein-based genome editing in vitro and in vivo." *Nature biotechnology* 33.1 (2015): 73. PubMed Rouet, Romain, et al. "Receptor-Mediated Delivery of CRISPR-Cas9 Endonuclease for Cell-Type-Specific Gene Editing." *Journal of the American Chemical Society* 140.21 (2018): 6596-6603. PubMed.

FIG. 68C provides data showing that various disclosed PE ribonucleoprotein complexes (PE2 at high concentration, PE3 at high concentration and PE3 at low concentration) can be delivered in this manner.

Delivery of PE by mRNA

Another method that may be employed to deliver prime editors and/or PEgRNAs to cells in which prime editing-based genome editing is desired is by employing the use of messenger RNA (mRNA) delivery methods and technologies. Examples of mRNA delivery methods and compositions that may be utilized in the present disclosure including, for example, PCT/US2014/028330, U.S. Pat. No. 8,822,663B2, NZ700688A, ES2740248T3, EP2755693A4, EP2755986A4, WO2014152940A1, EP3450553B1, BR112016030852A2, and EP3362461A1, each of which are incorporated herein by reference in their entireties. Additional disclosure hereby incorporated by reference can be found in Kowalski et al., "Delivering the Messenger: Advances in Technologies for Therapeutic mRNA Delivery," *Mol Therap.*, 2019; 27(4): 710-728.

In contrast to DNA vector encoding prime editors, the use of RNA as delivery agent for prime editors has the advantage that the genetic material does not have to enter the nucleus to perform its function. The delivered mRNA may be directly translated in the cytoplasm into the desired protein (e.g., prime editor fusion protein) and nucleic acid products (e.g., PEgRNA). However, in order to be more stable (e.g., resist RNA-degrading enzymes in the cytoplasm), it is in some embodiments necessary to stabilize the mRNA to improve delivery efficiency. Certain delivery carriers such as cationic lipids or polymeric delivery carriers can also help protect the transfected mRNA from endogenous RNase enzymes that might otherwise degrade the therapeutic mRNA encoding the desired prime editor fusion proteins. In addition, despite the increased stability of modified mRNA, delivery of mRNA, particularly mRNA encoding full-length protein, to cells in vivo in a manner that allows therapeutic levels of protein production remains a challenge.

With some exceptions, the intracellular delivery of mRNA is generally more challenging than that of small oligonucleotides, and it requires encapsulation into a delivery nanoparticle, in part due to the significantly larger size of mRNA molecules (300-5,000 kDa, ~1-15 kb) as compared to other types of RNAs (small interfering RNAs [siRNAs], ~14 kDa; antisense oligonucleotides [ASOs], 4-10 kDa).

mRNA must cross the cell membrane in order to reach the cytoplasm. The cell membrane is a dynamic and formidable barrier to intracellular delivery. It is made up primarily of a lipid bilayer of zwitterionic and negatively charged phospholipids, where the polar heads of the phospholipids point toward the aqueous environment and the hydrophobic tails form a hydrophobic core.

In some embodiments, the mRNA compositions of the disclosure comprise mRNA (encoding a prime editor and/or PEgRNA), a transport vehicle, and optionally an agent that facilitates contact with the target cell and subsequent transfection.

In some embodiments, the mRNA can include one or more modifications that confer stability to the mRNA (eg, compared to the wild-type or native version of the mRNA) and is involved in the associated abnormal expression of the protein. One or more modifications to the wild type that correct the defect may also be included. For example, the nucleic acids of the invention can include modifications of one or both of a 5' untranslated region or a 3' untranslated region. Such modifications may include the inclusion of sequences encoding a partial sequence of the cytomegalovirus (CMV) immediate early 1 (IE1) gene, poly A tail, Cap1 structure, or human growth hormone (hGH). In some embodiments, the mRNA is modified to reduce mRNA immunogenicity.

In one embodiment, the "prime editor" mRNA in the composition of the invention can be formulated in a liposome transfer vehicle to facilitate delivery to target cells. Contemplated transfer vehicles can include one or more cationic lipids, non-cationic lipids, and/or PEG-modified lipids. For example, the transfer vehicle can include at least one of the following cationic lipids: C12-200, DLin-KC2-DMA, DODAP, HGT4003, ICE, HGT5000, or HGT5001. In embodiments, the transfer vehicle comprises cholesterol (chol) and/or PEG modified lipids. In some embodiments, the transfer vehicle comprises DMG-PEG2K. In certain embodiments, the transfer vehicle has the following lipid formulation: C12-200, DOPE, chol, DMG-PEG2K; DODAP, DOPE, cholesterol, DMG-PEG2K; HGT5000, DOPE, chol, DMG-PEG2K, HGT5001, DOPE, chol, one of DMG-PEG2K.

The present disclosure also provides compositions and methods useful for facilitating transfection of target cells with one or more PE-encoding mRNA molecules. For example, the compositions and methods of the present invention contemplate the use of targeting ligands that can increase the affinity of the composition for one or more target cells. In one embodiment, the targeting ligand is apolipoprotein B or apolipoprotein E, and the corresponding target cells express low density lipoprotein receptors and thus promote recognition of the targeting ligand. A vast number of target cells can be preferentially targeted using the methods and compositions of the present disclosure. For example, contemplated target cells include hepatocytes, epithelial cells, hematopoietic cells, epithelial cells, endothelial cells, lung cells, bone cells, stem cells, mesenchymal cells, nerve cells, heart cells, adipocytes, vascular smooth muscle Includes cells, cardiomyocytes, skeletal muscle cells, beta cells, pituitary cells, synovial lining cells, ovarian cells, testis cells, fibroblasts, B cells, T cells, reticulocytes, leukocytes, granulocytes, and tumor cells However, it is not limited to these.

In some embodiments, the PE-encoding mRNA may optionally have chemical or biological modifications which, for example, improve the stability and/or half-life of such mRNA or which improve or otherwise facilitate protein production. Upon transfection, a natural mRNA in the compositions of the invention may decay with a half-life of between 30 minutes and several days. The mRNAs in the compositions of the disclosure may retain at least some ability to be translated, thereby producing a functional protein or enzyme. Accordingly, the invention provides compositions comprising and methods of administering a stabilized mRNA. In some embodiments, the activity of the mRNA is prolonged over an extended period of time. For example, the activity of the mRNA may be prolonged such that the compositions of the present disclosure are administered to a subject on a semi-weekly or bi-weekly basis, or more preferably on a monthly, bi-monthly, quarterly or an annual basis. The extended or prolonged activity of the mRNA of the present invention is directly related to the quantity of protein or enzyme produced from such mRNA. Similarly, the activity of the compositions of the present disclosure may be further extended or prolonged by modifications made to improve or enhance translation of the mRNA. Furthermore, the quantity of functional protein or enzyme produced by the target cell is a function of the quantity of mRNA delivered to the target cells and the stability of such mRNA. To the extent that the stability of the mRNA of the present invention may be improved or enhanced, the half-life, the activity of the produced protein or enzyme and the dosing frequency of the composition may be further extended.

Accordingly, in some embodiments, the mRNA in the compositions of the disclosure comprise at least one modification which confers increased or enhanced stability to the nucleic acid, including, for example, improved resistance to nuclease digestion in vivo. As used herein, the terms "modification" and "modified" as such terms relate to the nucleic acids provided herein, include at least one alteration which preferably enhances stability and renders the mRNA more stable (e.g., resistant to nuclease digestion) than the wild-type or naturally occurring version of the mRNA. As used herein, the terms "stable" and "stability" as such terms relate to the nucleic acids of the present invention, and particularly with respect to the mRNA, refer to increased or enhanced resistance to degradation by, for example nucleases (i.e., endonucleases or exonucleases) which are normally capable of degrading such mRNA. Increased stability can include, for example, less sensitivity to hydrolysis or other destruction by endogenous enzymes (e.g., endonucleases or exonucleases) or conditions within the target cell or tissue, thereby increasing or enhancing the residence of such mRNA in the target cell, tissue, subject and/or cytoplasm. The stabilized mRNA molecules provided herein demonstrate longer half-lives relative to their naturally occurring, unmodified counterparts (e.g. the wild-type version of the mRNA). Also contemplated by the terms "modification" and "modified" as such terms related to the mRNA of the present invention are alterations which improve or enhance translation of mRNA nucleic acids, including for example, the inclusion of sequences which function in the initiation of protein translation (e.g., the Kozak consensus sequence). (Kozak, M., Nucleic Acids Res 15 (20): 8125-48 (1987)).

In some embodiments, the mRNAs used in the compositions of the disclosure have undergone a chemical or biological modification to render them more stable. Exemplary modifications to an mRNA include the depletion of a base (e.g., by deletion or by the substitution of one nucleotide for another) or modification of a base, for example, the chemical modification of a base. The phrase "chemical modifications" as used herein, includes modifications which introduce chemistries which differ from those seen in naturally occurring mRNA, for example, covalent modifications such as the introduction of modified nucleotides, (e.g., nucleotide analogs, or the inclusion of pendant groups which are not naturally found in such mRNA molecules).

Other suitable polynucleotide modifications that may be incorporated into the PE-encoding mRNA used in the compositions of the disclosure include, but are not limited to, 4'-thio-modified bases: 4'-thio-adenosine, 4'-thio-guanosine, 4'-thio-cytidine, 4'-thio-uridine, 4'-thio-5-methyl-cytidine, 4'-thio-pseudouridine, and 4'-thio-2-thiouridine, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methylcytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof. The term modification also includes, for example, the incorporation of non-nucleotide linkages or modified nucleotides into the mRNA sequences of the present invention (e.g., modifications to one or both of the 3' and 5' ends of an mRNA molecule encoding a functional protein or enzyme). Such modifications include the addition of bases to an mRNA sequence (e.g., the inclusion of a poly A tail or a longer poly A tail), the alteration of the 3' UTR or the 5' UTR, complexing the mRNA with an agent (e.g., a protein or a complementary nucleic acid molecule), and inclusion of elements which change the structure of an mRNA molecule (e.g., which form secondary structures).

In some embodiments, PE-encoding mRNAs include a 5' cap structure. A 5' cap is typically added as follows: first, an RNA terminal phosphatase removes one of the terminal phosphate groups from the 5' nucleotide, leaving two terminal phosphates; guanosine triphosphate (GTP) is then added to the terminal phosphates via a guanylyl transferase, producing a 5'5'5 triphosphate linkage; and the 7-nitrogen of guanine is then methylated by a methyltransferase. Examples of cap structures include, but are not limited to, m7G(5')ppp (5'(A,G(5')ppp(5')A and G(5')ppp(5')G. Naturally occurring cap structures comprise a 7-methyl guanosine that is linked via a triphosphate bridge to the 5'-end of the first transcribed nucleotide, resulting in a dinucleotide cap of m7G(5')ppp(5')N, where N is any nucleoside. In vivo, the cap is added enzymatically. The cap is added in the nucleus and is catalyzed by the enzyme guanylyl transferase. The addition of the cap to the 5' terminal end of RNA occurs immediately after initiation of transcription. The terminal nucleoside is typically a guanosine, and is in the reverse orientation to all the other nucleotides, i.e., G(5')ppp(5') GpNpNp.

Additional cap analogs include, but are not limited to, a chemical structures selected from the group consisting of m7GpppG, m7GpppA, m7GpppC; unmethylated cap analogs (e.g., GpppG); dimethylated cap analog (e.g., m2,7GpppG), trimethylated cap analog (e.g., m2,2,7GpppG), dimethylated symmetrical cap analogs (e.g., m7Gpppm7G), or anti reverse cap analogs (e.g., ARCA; m7,2'OmeGpppG, m72'dGpppG, m7,3'OmeGpppG, m7,3'dGpppG and their tetraphosphate derivatives) (see, e.g., Jemieity, J. et al., "Novel 'anti-reverse' cap analogs with superior translational properties", RNA, 9: 1108-1122 (2003)).

Typically, the presence of a "tail" serves to protect the mRNA from exonuclease degradation. A poly A or poly U tail is thought to stabilize natural messengers and synthetic sense RNA. Therefore, in certain embodiments a long poly A or poly U tail can be added to an mRNA molecule thus rendering the RNA more stable. Poly A or poly U tails can be added using a variety of art-recognized techniques. For example, long poly A tails can be added to synthetic or in vitro transcribed RNA using poly A polymerase (Yokoe, et al. Nature Biotechnology. 1996; 14: 1252-1256). A transcription vector can also encode long poly A tails. In addition, poly A tails can be added by transcription directly from PCR products. Poly A may also be ligated to the 3' end of a sense RNA with RNA ligase (see, e.g., Molecular Cloning A Laboratory Manual, 2nd Ed., ed. by Sambrook, Fritsch and Maniatis (Cold Spring Harbor Laboratory Press: 1991 edition)).

Typically, the length of a poly A or poly U tail can be at least about 10, 50, 100, 200, 300, 400 at least 500 nucleotides. In some embodiments, a poly-A tail on the 3' terminus of mRNA typically includes about 10 to 300 adenosine nucleotides (e.g., about 10 to 200 adenosine nucleotides, about 10 to 150 adenosine nucleotides, about 10 to 100 adenosine nucleotides, about 20 to 70 adenosine nucleotides, or about 20 to 60 adenosine nucleotides). In some embodiments, mRNAs include a 3' poly(C) tail structure. A suitable poly-C tail on the 3' terminus of mRNA typically include about 10 to 200 cytosine nucleotides (e.g., about 10 to 150 cytosine nucleotides, about 10 to 100 cytosine nucleotides, about 20 to 70 cytosine nucleotides, about 20 to 60 cytosine nucleotides, or about 10 to 40 cytosine nucleotides). The poly-C tail may be added to the poly-A or poly U tail or may substitute the poly-A or poly U tail.

PE-encoding mRNAs according to the present disclosure may be synthesized according to any of a variety of known methods. For example, mRNAs according to the present invention may be synthesized via in vitro transcription (IVT). Briefly, IVT is typically performed with a linear or circular DNA template containing a promoter, a pool of ribonucleotide triphosphates, a buffer system that may include DTT and magnesium ions, and an appropriate RNA polymerase (e.g., T3, T7 or SP6 RNA polymerase), DNAse I, pyrophosphatase, and/or RNAse inhibitor. The exact conditions will vary according to the specific application.

In embodiments involving mRNA delivery, the ratio of the mRNA encoding the PE fusion protein to the PEgRNA may be important for efficient editing. In certain embodiments, the weight ratio of mRNA (encoding the PE fusion protein) to PEgRNA is 1:1. In certain other embodiments, the weight ratio of mRNA (encoding the PE fusion protein) to PEgRNA is 2:1. In still other embodiments, the weight ratio of mRNA (encoding the PE fusion protein) to PEgRNA is 1:2. In still further embodiments, the weight ratio of mRNA (encoding the PE fusion protein) to PEgRNA is selected from the group consisting of about 1:1000, 1:900; 1:800; 1:700; 1:600; 1:500; 1:400; 1:300; 1:200; 1:100; 1:90; 1:80; 1:70; 1:60; 1:50; 1:40; 1:30; 1:20; 1:10; and 1:1. In other embodiments, the weight ratio of mRNA (encoding the PE fusion protein) to PEgRNA is selected from the group consisting of about 1:1000, 1:900; 800:1; 700:1; 600:1; 500:1; 400:1; 300:1; 200:1; 100:1; 90:1; 80:1; 70:1; 60:1; 50:1; 40:1; 30:1; 20:1; 10:1; and 1:1.

J. Use of Prime Editing for Identifying Off-Target Editing in an Unbiased Manner Like other genome editors, there exists some risk that PE may introduce its programmed genetic alterations at unintended sites around the genome, i.e., "off-target" sites. However, there are currently no described methods to detect off-target editing with prime editors. Such methods would allow the identification of potential sites of off-target editing using prime editors.

The key concept of this aspect is the idea of using prime editing to insert the same adapter sequence and/or primer binding site at on-target and off-target sites, templated from the same PEgRNA, to enable the rapid identification of genomic off-target modification sites of napDNAbp nucleases or prime editors. This method is distinguished from other techniques that identify nuclease off-target sites because the adapter and/or primer binding sequence is inserted in the same event as DNA binding and nicking by the napDNAbp, simplifying the downstream processing.

FIG. 33 illustrates the basic principle of off-target identification. The figure is a schematic showing PEgRNA design for primer binding sequence insertions and primer binding insertion into genomic DNA using prime editing for determining off-target editing. In this embodiment, prime editing is conducted inside a living cell, a tissue, or an animal model. As a first step, an appropriate PEgRNA is designed. The top schematic shows a exemplary PEgRNA that may be used in this aspect. The spacer in the PEgRNA (labeled as "protospacer") is complementary to one of the strands of the genomic target. The PE:PEgRNA complex (i.e., the PE complex) installs a single stranded 3' end flap at the nick site which contains the encoded primer binding sequence and the region of homology (coded by the homology arm of the PEgRNA) that is complementary to the region just downstream of the cut site (in red). Through flap invasion and DNA repair/replication processes, the synthesized strand becomes incorporated into the DNA, thereby installing the primer binding site. This process can occur at the desired genomic target, but also at other genomic sites that might interact with the PEgRNA in an off-target manner (i.e., the PEgRNA guides the PE complex to other off-target sites due to the complementarity of the spacer region to other genomic sites that are not the intended genomic site). Thus, the primer binding sequence may be installed not only at the desired genomic target, but at off-target genomic sites elsewhere in the genome. In order to detect the insertion of these primer binding sites at both the intended genomic target sites and the off-target genomic sites, the genomic DNA (post-PE) can be isolated, fragmented, and ligated to adapter nucleotides (shown in red). Next, PCR may be carried out with PCR oligonucleotides that anneal to the adapters and to the inserted primer binding sequence to amplify on-target and off-target genomic DNA regions into which the primer binding site was inserted by PE. High throughput sequencing then may be conducted, as well as sequence alignments, to identify the insertion points of PE-inserted primer binding sequences at either the on-target site or at off-target sites.

Thus, FIG. 33 illustrates one aspect regarding the identification of off-target editing sites when editing inside a living cell, in tissue culture or animal models. To conduct this method, a PEgRNA is generated that has an identical spacer to the final desired prime editor (and, if looking at prime editing off-targets, an identical primer-binding site sequence to the final desired editor), but includes the necessary sequences to install an adapter or primer binding site after reverse transcription by prime editing. In vivo editing is conducted using a prime editor or RT-fused nuclease, and isolate genomic DNA. The genomic DNA is fragmented by enzymatic or mechanical means and append a different adapter to sites of DNA fragmentation. PCR is used to amplify from one adapter to the adapter installed via PEgRNA. The resulting product is deep-sequenced to identify all modified sites.

In another aspect, evaluation of off-target editing by PE may be conducted in vitro. In this aspect, PE may be used during in vitro modification of genomic DNA identification of off-target editing sites using in vitro modification of genomic DNA. To conduct this method, ribonucleoprotein (RNP) of purified prime editor fusion protein and a PEgRNA (i.e., the PE complex) is assembled that is configured to install an adapter or primer binding sequence at a target site, but is otherwise the same as the PEgRNA of interest. This RNP (i.e., PE complex) is incubated with extracted genomic DNA before or after fragmentation of the DNA. After fragmentation, different adapters sequences are ligated to the ends of the fragment DNA. PCR is used to amplify those genomic sites that span the inserted adapter sequence (i.e., inserted by EP) and the adapters ligated to fragment ends. High throughput sequencing between the adapters sequences can identify genomic sites of modification that are on-target and off-target. This in vitro editing method should enhance the sensitivity of detection because cellular DNA repair will not eliminate the reverse-transcribed DNA adapter added by the prime editor.

These methods could be used to identify off-target editing for any prime editor, or any genome editor that uses a guide RNA to recognize a target cut site (most Cas nucleases).

These methods could be applied to all genetic diseases for which genome editors are considered for use in treatment.

Exemplary adapter and/or primer binding sequences that may be installed by PE include, but are not limited to:

| ADAPTER 1 | 5'-CGGTGGACCGATGATCT-3' (SEQ ID NO: 177) |
|---|---|
| ADAPTER 2 | 5'-GCCACCTGGCTACTAGA-3' (SEQ ID NO: 178) |
| ADAPTER 3 | 5'-AGATCATCGGTCCACCG-3' (SEQ ID NO: 179) |
| ADAPTER 4 | 5'-TCTAGTAGCCAGGTGGC-3' (SEQ ID NO: 180) |

These adapter and/or primer binding sequences may also be used in the ligation step after genomic DNA fragmentation as outlined above.

Exemplary PEgRNA designs that illustrate the use of the herein described method to evaluate off-target editing, and their edit target locus, are as follows:

| HEK3 TEST LOCUS OFF-TARGET DISCOVERY: | *GGCCCAGACTGAGCACGTGAGTTTTAGAGCTAGAAATA GCAAGTTAAAATAAGGCTAGTCCGTTATCAACTTGAA AAAGTGGCACCGAGTCGGTGC*TCTGCCATCA*CGGTG GACCGATGATCT*CGTGCTCAGTCTG (SEQ ID NO: 181) |
|---|---|
| HEK4 TEST LOCUS OFF-TARGET DISCOVERY: | GGCACTGCGGCTGGAGGTGGGTTTTAGAGCTAGAAAT AGCAAGTTAAAATAAGGCTAGTCCGTTATCAACTTGA AAAAGTGGCACCGAGTCGGTGCACACAGCACCAGAG TCTCCGCTTTAACCCCCA*GCCACCTGGCTACTAGA*CC TCCAGCC (SEQ ID NO: 182) |
| SICKLE CELL CORRECTION OFF-TARGET DISCOVERY: | GCATGGTGCACCTGACTCCTGGTTTTAGAGCTAGAAA TAGCAAGTTAAAATAAGGCTAGTCCGTTATCAACTTG AAAAAGTGGCACCGAGTCGGTGCAGACTTCTCTTCA *GGCCACCTGGCTACTAGA*GAGTCAGGTGCAC (SEQ ID NO: 183) |

KEY
PBS Spacer
sgRNA scaffold
DNA synthesis template
*Adapter*
PBS

K. Use of Prime Editing for Insertion of Inducible Dimerization Domains

The prime editors described herein may also be used to install dimerization domains into one or more protein targets. The dimerization domains may facilitate inducible regulation of the activity associated with the dimerization of the one or more protein targets via a linking moiety (e.g., a small molecule, peptide, or protein) that binds in a bi-specific manner. In various aspects, the dimerization domains, when installed on different proteins (e.g., the same type or different proteins), each bind to the same bi-specific moiety (e.g., a bi-specific small molecule, peptide, or polypeptide having a least two regions that separately bind to the dimerization domains), thereby causing the dimerization of the proteins through their common interaction to the bi-specific ligand. In this manner, the bi-specific ligand functions as an "inducer" of dimerization of two proteins. In some cases, the bi-specific ligand or compound will have two targeting moieties that are the same. In other embodiments, the bi-specific ligand or compound will have targeting moieties that are each different from the other. The bi-specific ligand or compound having the same two targeting moieties will be able to target the same dimerization domain installed on different protein targets. The bi-specific ligand or compound having different targeting moieties will be able to target different dimerization domains installed on different protein targets.

As used herein, the term "dimerization domain" refers to a ligand-binding domain that binds to a binding moiety of a bi-specific ligand. A "first" dimerization domain binds to a first binding moiety of a bi-specific ligand and a "second" dimerization domain binds to a second binding moiety of the same bi-specific ligand. When the first dimerization domain is fused to a first protein (e.g., via PE, as discussed herein) and the second dimerization domain (e.g., via PE, as discussed herein) is fused to a second protein, the first and second protein dimerize in the presence of a bi-specific ligand, wherein the bi-specific ligand has at least one moiety that binds to the first dimerization domain and at least another moiety that binds to the second dimerization domain.

The term "bi-specific ligand" or "bi-specific moiety," as used herein, refers to a ligand that binds to two different ligand-binding domains. In various embodiments, the bi-specific moiety itself is a dimer of two of same or two different chemical moieties, wherein each moiety specifically and tightly binds to a dimerization domain. In certain embodiments, the ligand is a small molecule compound, or a peptide, or a polypeptide. In other embodiments, ligand-binding domain is a "dimerization domain," which can be install as a peptide tag onto a protein. In various embodiments, two proteins each comprising the same or different dimerization domains can be induced to dimerize through the binding of each dimerization domain to the bi-specific ligand. These molecules may also be referred to as "chemical inducers of dimerization" or CIDs. In addition, the bi-specific ligands may be prepared by coupling (e.g., through standardize chemical linkages) two of the same moieties together, or two different moieties together, wherein each moiety tightly and specifically binds to a dimerization domain.

In various aspects, the dimerization domains installed by PE can be the same or different.

For example, the dimerization domains can be FKBP12, which has the following amino acid sequence:

| FKBP12 | MGVQVETISPGDGRTFPKRGQTCVVHYTG<br>MLEDGKKFDSSRDRNKPFKFMLGKQEVIR<br>GWEEGVAQMSVGQRAKLTISPDYAYGATG<br>HPGIIPPHATLVFDVELLKLE<br>(SEQ ID NO: 488) |
|---|---|

In another example, the dimerization domain can be a mutant of FKBP12 referred to as FKBP12-F36V, a mutant of FKBP12 with an engineered hole that binds a synthetic bumped FK506 mimic (2, FIG. 3)[107]:

| FKBP12-F36V | MGVQVETISPGDGRTFPKRGQTCVVHYTG<br>MLEDGKKVDSSRDRNKPFKFMLGKQEVI<br>RGWEEGVAQMSVGQRAKLTISPDYAYGAT<br>GHPGIIPPHATLVFDVELLKLE<br>(SEQ ID NO: 489) |
|---|---|

In another example, the dimerization domain can be cyclophilin, as follows:

| CYCLOPHILIN | MVNPTVFFDIAVDGEPLGRVSFELFADKVP<br>KTAENFRALSTGEKGFGYKGSCFHRIIPGF<br>MCQGGDFTRHNGTGGKSIYGEKFEDENFI<br>LKHTGPGILSMANAGPNTNGSQFFICTAKT<br>EWLDGKHVVFGKVKEGMNIVEAMERFGS<br>RNGKTSKKITIADCGQLE<br>(SEQ ID NO: 490) |
|---|---|

In various embodiments, the amino acid sequences of these dimerization domains may be altered in order to optimize binding or to improve binding orthogonality to native targets. The nucleic acid sequences of the genes encoding small-molecule binding proteins may be altered in order to optimize the efficiency of the PE process, such as by reducing PEgRNA secondary structure.

Other examples of suitable dimerization domains and a cognate small molecule compound which binds thereto are provided as follows. Note that the cognate small molecule compound could be coupled (e.g., via a chemical linker) to a second small molecule compound (either the same compound or a different compound) in order to form a bi-specific ligand that may bind two dimerization domains. In some cases, such as FK506 and cyclosporin A, dimerization of each (e.g., FK506-FK506 or cyclosporin A-cyclosporin A) reduces or eliminates immunosuppressive activity of the monomeric compounds.

| SMALL MOLECULE - BINDS TO THE DIMERIZATION DOMAIN - A DIMER OF THESE MOLECULES WOULD CONSTITUTE A BI-SPECIFIC LIGAND THAT WOULD BIND TWO DIMERIZATION DOMAINS | DIMERIZATION DOMAIN(S) |
|---|---|
| FK506 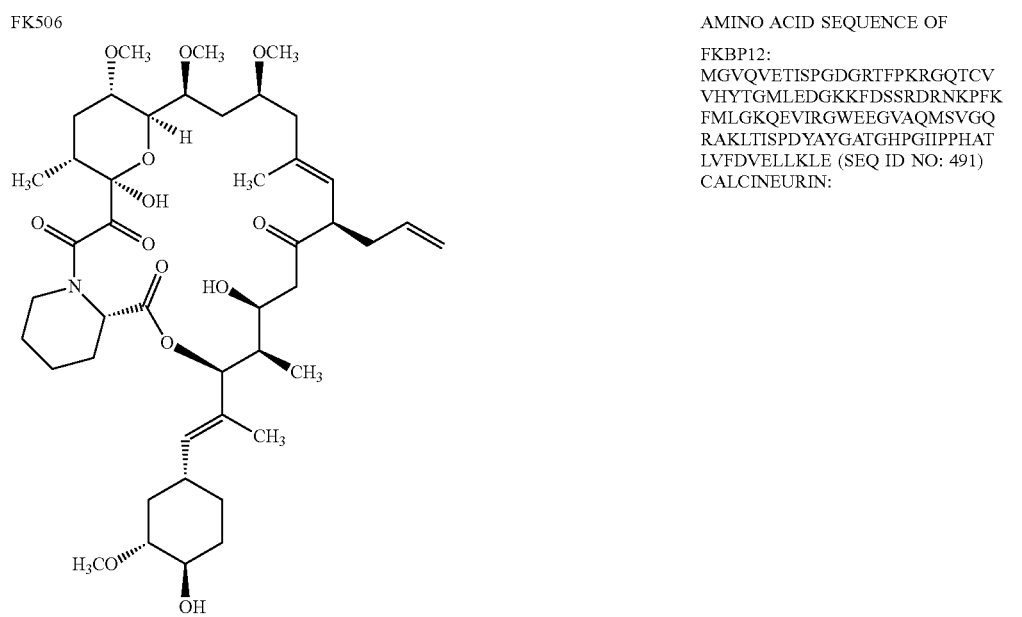 | AMINO ACID SEQUENCE OF FKBP12: MGVQVETISPGDGRTFPKRGQTCV VHYTGMLEDGKKFDSSRDRNKPFK FMLGKQEVIRGWEEGVAQMSVGQ RAKLTISPDYAYGATGHPGIIPPHAT LVFDVELLKLE (SEQ ID NO: 491) CALCINEURIN: |

| | |
|---|---|
| SMALL MOLECULE - BINDS TO THE DIMERIZATION DOMAIN - A DIMER OF THESE MOLECULES WOULD CONSTITUTE A BI-SPECIFIC LIGAND THAT WOULD BIND TWO DIMERIZATION DOMAINS | DIMERIZATION DOMAIN(S) |

FK-506
FKBP12 Kd 0.4 nM
*PNAS* 1990, 87, 9231.
TARGETS: FKBP12 + CALCINEURIN

CYCLOSPORIN A

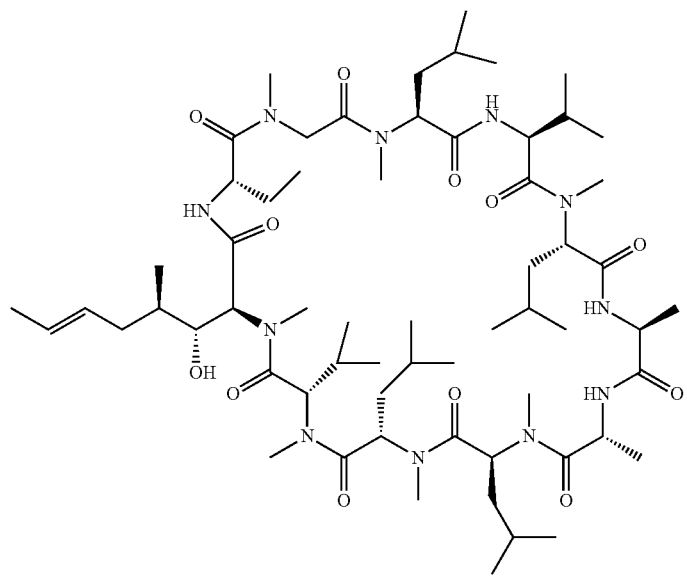 [SMILES: C/C=C/C[C@@H](C)[C@@H](O)[C@H]1C(=O)N[C@@H](CC)C(=O)N(C)CC(=O)N(C)[C@@H](CC(C)C)C(=O)N[C@@H](C(C)C)C(=O)N(C)[C@@H](CC(C)C)C(=O)N[C@@H](C)C(=O)N[C@H](C)C(=O)N(C)[C@@H](CC(C)C)C(=O)N(C)[C@@H](CC(C)C)C(=O)N(C)[C@@H](C(C)C)C(=O)N1C]

TARGETS: CYCLOPHILIN + CALCINEURIN

AMINO ACID SEQUENCE OF HUMAN CYCLOPHILIN A:
MVNPTVFFDIAVDGEPLGRVSFELF
ADKVPKTAENFRALSTGEKGFGYK
GSCFHRIIPGFMCQGGDFTRHNGTG
GKSIYGEKFEDENFILKHTGPGILSM
ANAGPNTNGSQFFICTAKTEWLDG
KHVVFGKVKEGMNIVEAMERFGS
RNGKTSKKITIADCGQLE (SEQ ID NO: 490)

AMINO ACID SEQUENCE OF HUMAN CYCLOPHILIN B:
MLRLSERNMKVLLAAALIAGSVFF
LLLPGPSAADEKKKGPKVTVKVYF
DLRIGDEDVGRVIFGLFGKTVPKTV
DNFVALATGEKGFGYKNSKFHRVIK
DFMIQGGDFTRGDGTGGKSIYGER
FPDENFKLKHYGPGWVSMANAGK
DTNGSQFFITTVKTAWLDGKHVVF
GKVLEGMEVVRKVESTKTDSRDKP
LKDVIIADCGKIEVEKPFAIAKE (SEQ ID NO: 493)

AMINO ACID SEQUENCE OF MURINE CYCLOPHILIN C:
MSPGPRLLLPAVLCLGLGALVSSSG
SSGVRKRGPSVTDKVFFDVRIGDK
DVGRIVIGLFGNVVPKTVENFVALA
TGEKGYGYKGSIFHRVIKDFMIQGG
DFTARDGTGGMSIYGETFPDENFKL
KHYGIGWVSMANAGPDTNGSQFFI
TLTKPTWLDGKHVVFGKVLDGMT
VVHSIELQATDGHDRPLTDCTIVNS
GKIDVKTPFVVEVPDW (SEQ ID NO: 494)

AP1867

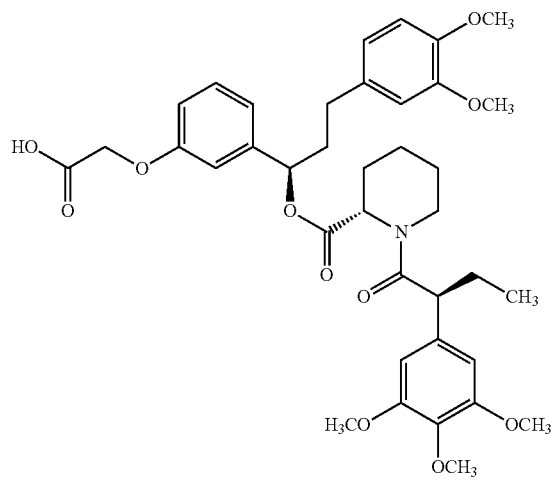 [SMILES: CC[C@H](C(=O)N1CCCC[C@H]1C(=O)O[C@H](CCc1ccc(OC)c(OC)c1)c1cccc(OCC(=O)O)c1)c1cc(OC)c(OC)c(OC)c1]

AMINO ACID SEQUENCE OF FKBP12-F36V
MGVQVETISPGDGRTFPKRGQTCV
VHYTGMLEDGKKVDSSRDRNKPF
KFMLGKQEVIRGWEEGVAQMS VG
QRAKLT
ISPDYAYGATGHPGIIPPHATLVFDV
ELLKLE (SEQ ID NO: 495)

| SMALL MOLECULE - BINDS TO THE DIMERIZATION DOMAIN - A DIMER OF THESE MOLECULES WOULD CONSTITUTE A BI-SPECIFIC LIGAND THAT WOULD BIND TWO DIMERIZATION DOMAINS | DIMERIZATION DOMAIN(S) |
|---|---|
| AP1867<br>FK-506 mimic<br>FKBP12 F36V Kd 94 pM<br>FKBP12 Kd 67 nM<br>*PNAS* 1998, 95, 10437.<br>TARGET(S): FKBP12 | |
| METHOTREXATE<br>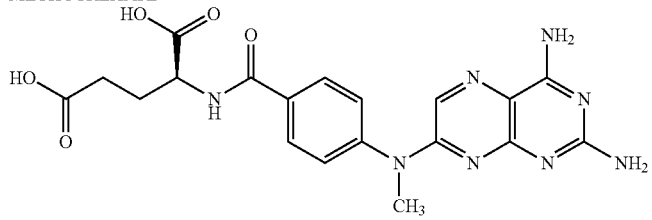 [SMILES: CN(c1ccc(C(=O)N[C@@H](CCC(=O)O)C(=O)O)cc1)c1cnc2c(N)nc(N)nc2n1]<br>methotrexate<br>Human DHFR Kd < 10 nM<br>*J. Biol. Chem.* 1988, 263, 10304.<br>*E. coli* DHFR Kd 9.5 nM<br>*PNAS* 2002, 99, 13481.<br>TARGET(S): DIHYDROFOLATE REDUCTASE | AMINO ACID SEQUENCE OF HUMAN DIHYDROFOLATE REDUCTASE<br>MVGS LNCIVAVSQNMGIGKNGDLP WPPLRNEFRYFQRMTTTSSVEGKQ NLVIMGKKTWFSIPEKNRPLKGRIN LVLSRELKEPPQGAHFLSRSLDDAL KLTEQPELANKVDMVWIVGGSSVY KEAMNHPGHLKLFVTRIMQDFESD TFFPEIDLEKYKLLPEYPGVLSDVQ EEKGIKYKFEVYEKND (SEQ ID NO: 496) |
| TRIMETHOPRIM<br>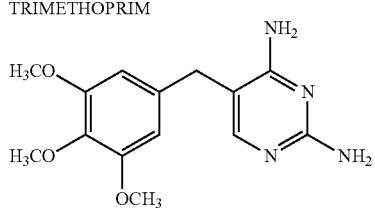<br>trimethoprim<br>*E. coli* DHFR K$_I$ 1.3 nM<br>*Biochemistry* 1982, 21, 5068.<br>TARGET(S): DIHYDROFOLATE REDUCTASE | AMINO ACID SEQUENCE FOR *E. COLI* DIHYDROFOLATE REDUCTASE<br>MISLIAALAVDRVIGMENAMPWNL PADLAWFKRNTLNKPVIMGRHTWE SIGRPLPGRKNIILSSQPGTDDRVTW VKSVDEAIAACGDVPEIMVIGGGRV YEQFLPKAQKLYLTHIDAEVEGDTH FPDYEPDDWESVFSEFHDADAQNS HSYCFEILERR (SEQ ID NO: 497) |
| DEXAMETHOSONE<br>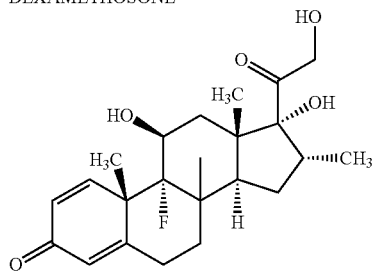<br>dexamethasone<br>Human GR Kd 4.6 nM<br>*Mol. Endocrin.* 1999, 13, 1855. | AMINO ACID SEQUENCE FOR HUMAN GLUCOCORTICOID RECEPTOR<br>MDSKESLTPGREENPSSVLAQERGD VMDFYKTLRGGATVKVSASSPSLA VASQSDSKQRRLLVDFPKGSVSNA QQPDLSKAVSLSMGLYMGETETKV MGNDLGFPQQGQISLSSGETDLKLL EESIANLNRSTSVPENPKSSASTAVS AAPTEKEF PKTHSDVSSEQQHLKGQTGTNGGN VKLYTTDQSTFDILQDLEFSSGSPG KETNESPWRSDLLIDENCLLSPLAG EDDSFLLEGNSNEDCKPLILPDTKP KIKDNGDLVLSSPSNVTLPQVKTEK EDFIELCTPGVIKQEKLGTVYCQAS FPGANIIGNKMSAISVHGVSTSGGQ MYHYDMNTASLSQQQDQKPIFNVI PPIPVGSENWNRCQGSGDDNLTSLG TLNFPGRTVFSNGYSSPSMRPDVSS PPSSSSTATTGPPPKLCLVCSDEASG CHYGVLTCGSCKVFFKRAVEGQHN YLCAGRNDCIIDKIRRKNCPACRYR KCLQAGMNLEARKTKKKIKGIQQA TTGVSQETSENPGNKTIVPATLPQLT PTLVSLLEVIEPEVLYAGYDSSVPDS TWRIMTTLNMLGGRQVIAAVKWA KAIPGFRNLHLDDQMTLLQYSWMF LMAFALGWRSYRQSSANLLCFAPD LIINEQRMTLPCMYDQCKHMLYVS SELHRLQVSYEEYLCMKTLLLLSSV PKDGLKSQELFDEIRMTYIKELGKA IVKREGNSSQNWQRFYQLTKLLDS |

-continued

| SMALL MOLECULE - BINDS TO THE DIMERIZATION DOMAIN - A DIMER OF THESE MOLECULES WOULD CONSTITUTE A BI-SPECIFIC LIGAND THAT WOULD BIND TWO DIMERIZATION DOMAINS | DIMERIZATION DOMAIN(S) |
|---|---|
| 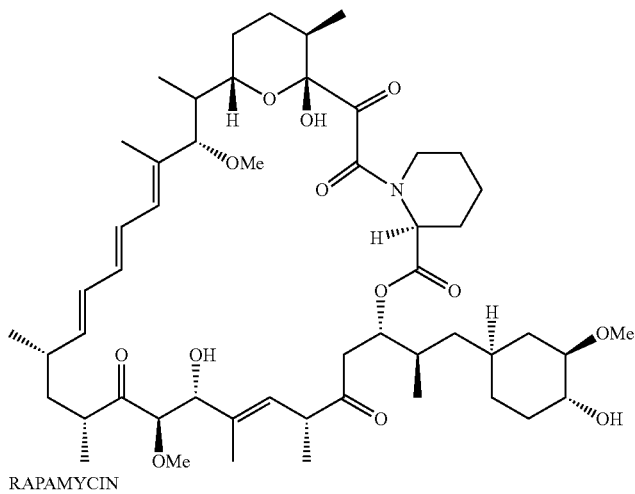<br>RAPAMYCIN | MHEVVENLLNYCFQTFLDKTMSIE FPEMLAEIITNQIPKYSNGNIKKLLF HQK (SEQ ID NO: 498)<br><br>AMINO ACID SEQUENCE OF FKBP12:<br>MGVQVETISPGDGRTFPKRGQTCV VHYTGMLEDGKKFDSSRDRNKPFK FMLGKQEVIRGWEEGVAQMSVGQ RAKLTISPDYAYGATGHPGIIPPHAT LVFDVELLKLE (SEQ ID NO: 491) |

Other examples of naturally occurring bifunctional molecules and their dual target receptors are as follows. Prime editing may be used to install the dual target receptors into different proteins. Once the different proteins are modified by PE to contain a bifunctional molecule receptor, the bifunctional molecules may be introduced, thereby causing the dimerization of the proteins modified to comprise the different dimerization domains. Examples of pairings of (1) a bifunctional molecule and (2) their dual target receptors are as follows:

| NATURALLY OCCURRING BIOFUNCTIONAL MOLECULES | TARGET RECEPTORS OF THE BIOFUNCTIONAL MOLECULE |
|---|---|
| 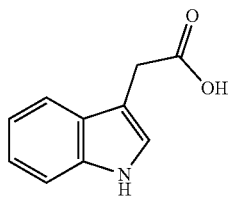 [SMILES: O=C(O)Cc1c[nH]c2ccccc12] | Target receptor 1: auxin receptor<br>Target receptor 2: TIR1 E3 ligase |
| 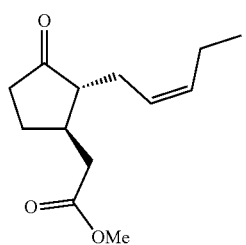 [SMILES: CC/C=C\C[C@H]1C(=O)CC[C@@H]1CC(=O)OC]<br>methyl jasmonate | Target receptor 1: JAZ receptor<br>Target receptor 2: CoI1 E3 ligase |

-continued

| NATURALLY OCCURRING BIOFUNCTIONAL MOLECULES | TARGET RECEPTORS OF THE BIOFUNCTIONAL MOLECULE |
|---|---|
| brefeldin A 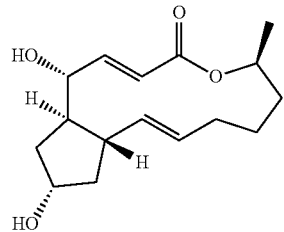 | target receptor 1: GBF1<br>target receptor 2: GTPase Arf1p |
| abscisic acid 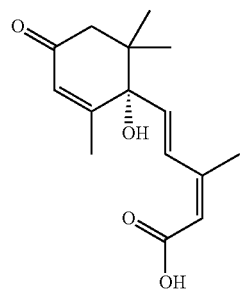 [SMILES: CC1=CC(=O)CC(C)(C)[C@@]1(O)/C=C/C(C)=C\C(=O)O] | target receptor 1: PYR receptor<br>target receptor 2: phosphoprotein phosphatase 2C |
| Forskolin 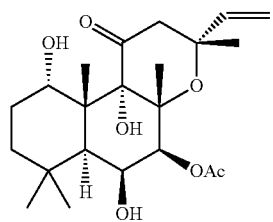 | target receptor 1: adenylyl cyclase monomers<br>target receptor 2: adenylyl cyclase monomers |
| fusicoccin A 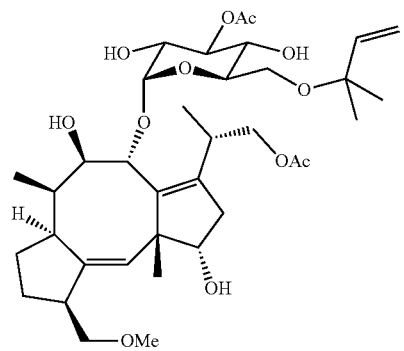 | target receptor 1: 14-3-3 proteins<br>target receptor 2: $H^+$-ATPase |

-continued
| NATURALLY OCCURRING BIOFUNCTIONAL MOLECULES | TARGET RECEPTORS OF THE BIOFUNCTIONAL MOLECULE |
|---|---|
| Rapamycin 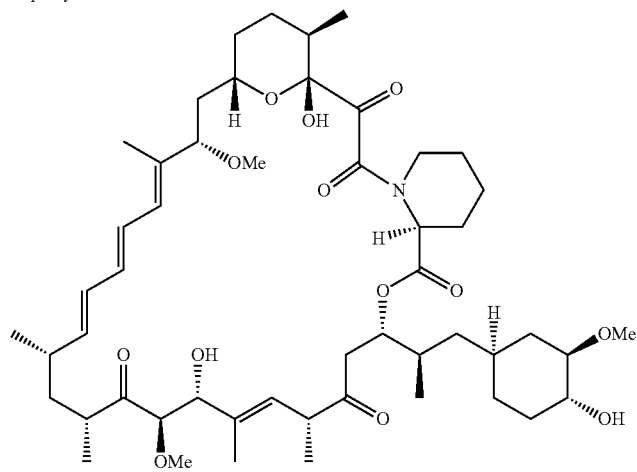 | target receptor 1: FKBP12<br>target receptor 2: mTOR |
| sanglifehrin A 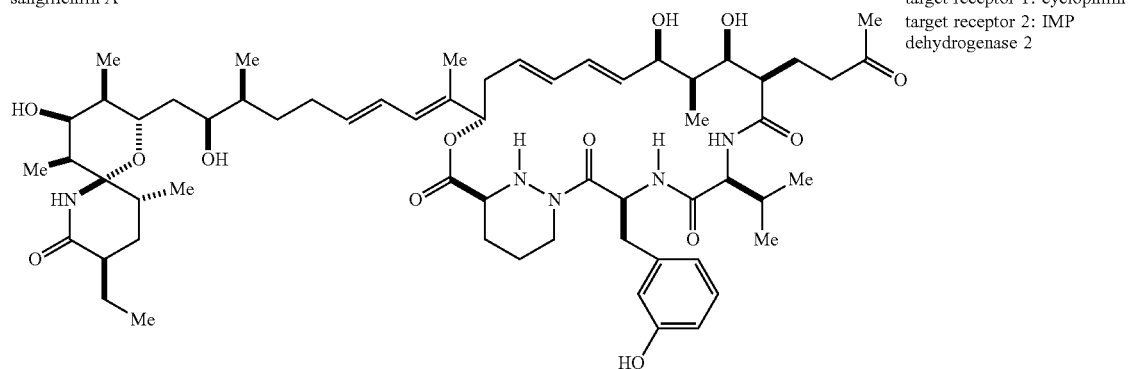<br>Sanglifehrin A (SEA) | target receptor 1: cyclophilin<br>target receptor 2: IMP dehydrogenase 2 |
| cyclosporin A 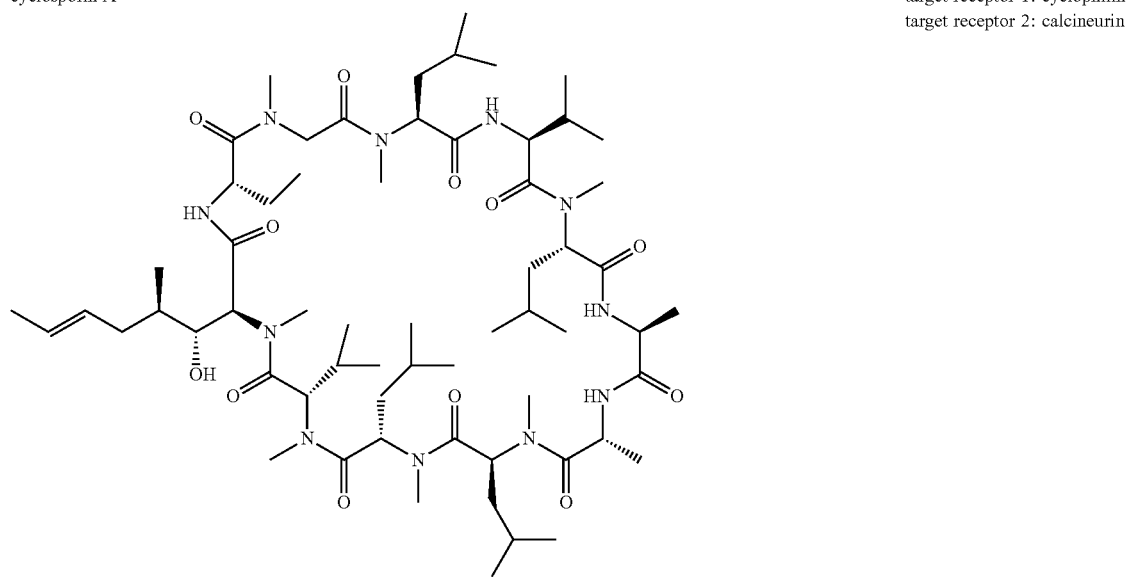 | target receptor 1: cyclophilin<br>target receptor 2: calcineurin |

Examples of other bifunctional molecules that can be used with this aspect of prime editing are as follows:

Synstab A:

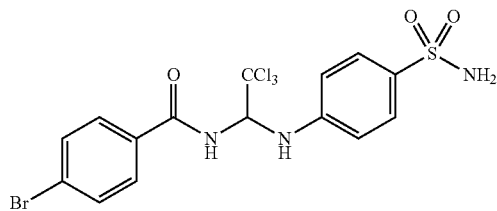

Paclitaxel:

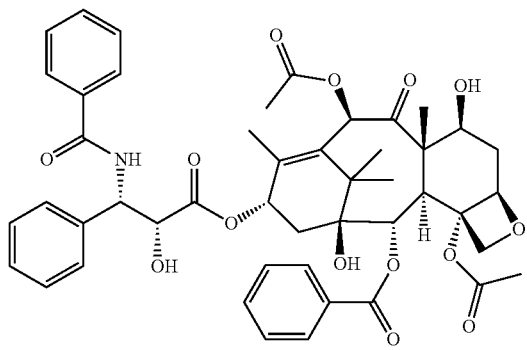 [SMILES: CC(=O)O[C@H]1C(=O)[C@@]2(C)[C@H]([C@H](OC(=O)c3ccccc3)[C@]3(O)C[C@H](OC(=O)[C@H](O)[C@@H](NC(=O)c4ccccc4)c4ccccc4)C(C)=C1C3(C)C)[C@]1(OC(C)=O)CO[C@@H]1C[C@@H]2O]

Discodermolide:

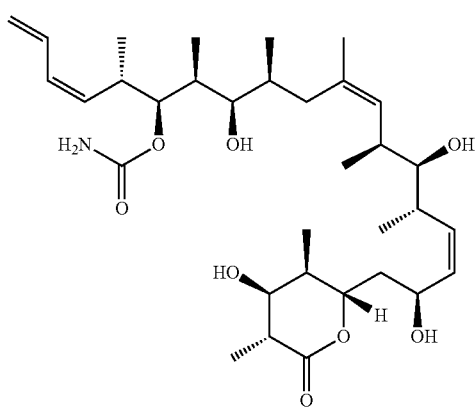 [SMILES: C=C/C=C\[C@H](C)[C@H](OC(N)=O)[C@@H](C)[C@H](O)[C@@H](C)C/C(C)=C\[C@H](C)[C@@H](O)[C@@H](C)/C=C\[C@@H](O)C[C@@H]1OC(=O)[C@H](C)[C@@H](O)[C@H]1C]

GNE-0011

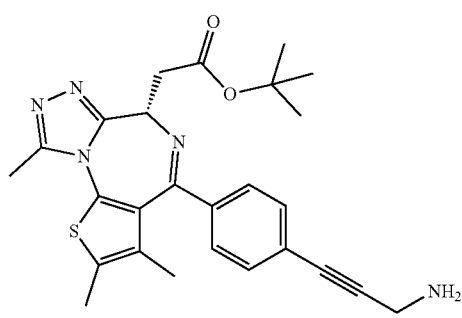 [SMILES: Cc1sc2c(c1C)C(c1ccc(C#CCN)cc1)=N[C@@H](CC(=O)OC(C)(C)C)c1nnc(C)n1-2]

ARV-825, and dBET1

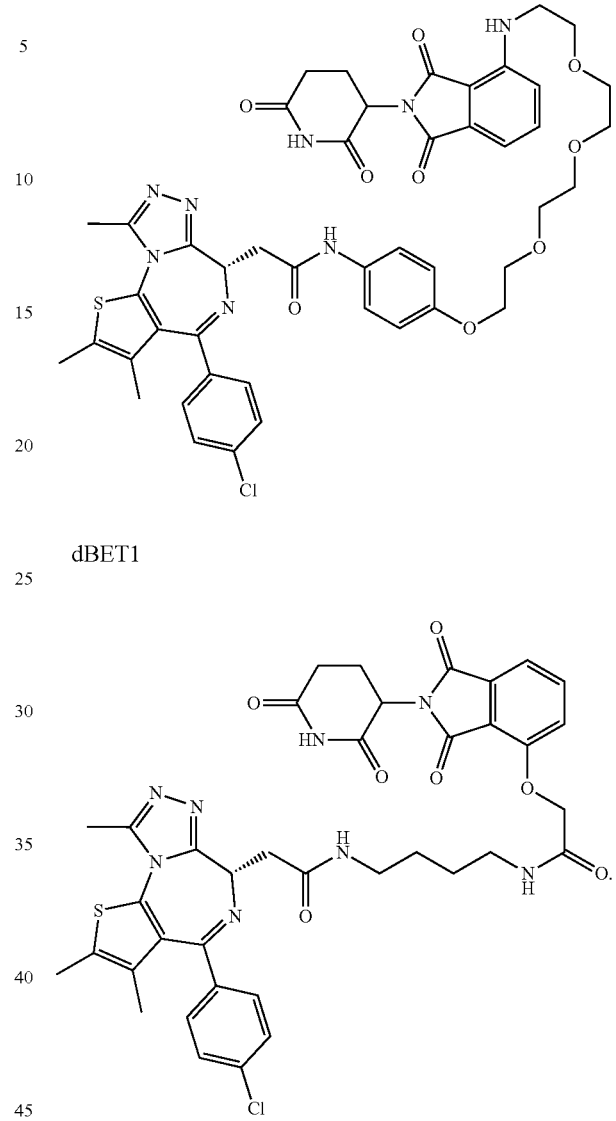

Synstab A, paclitaxel, and discodermolide are microtubule stabilizers. Thus, these compounds could be used to dimerize proteins modified by PE to comprise microtubule proteins. GNE-0011, ARV-825, and dBET1 comprise a BRD4 binding motif and a CRBN binding motif. Thus, these compounds could be used to dimerize proteins modified by PE to comprise these targeting domains.

The PEgRNAs for installing dimerization domains may comprising the following structures (in reference to FIG. 3D):

5'-[spacer]-[gRNA core]-[extension arm]-3', wherein the the extension arm comprises 5'-[homology arm]-[edit template]-[primer binding site]-3'; or 5'-[extension arm]-[spacer]-[gRNA core]-3', wherein the the extension arm comprises 5'-[homology arm]-[edit template]-[primer binding site]-3', and wherein with either configuration the "edit template" comprises a nucleotide sequence of a dimerization domain.

In one example, the PEgRNA for insertion of the FKBP12 dimerization domain at the C-terminal end of human insulin receptor (spacer underlined, gRNA core plain, flap homology bold, FKBP12 insertion in italics, annealing region bold italics):

| PEGRNA FOR INSTALLING FKBP12 IN HUMAN INSULIN RECEPTOR | CACGGUAGGCACUGUUAGGAGUUUUAG AGCUAGAAAUAGCAAGUUAAAAUAAG GCUAGUCCGUUAUCAACUUGAAAAAGU GGCACCGAGUCGGUGCUUGCCUCGGU CCAAUCCUUCCGGAGUGCAGGUGGAAA CCAUCUCCCCAGGAGACGGGCGCACCUU CCCCAAGCGCGGCCAGACCUGCGUGGUG CACUACACCGGGAUGCUUGAAGAUGGAA |
|---|---|

In another example, the PEgRNA for insertion of the FKBP12 dimerization domain at the HEK3 locus (for optimization):

| PEGRNA FOR INSTALLING FKBP12 IN HEK3 | GGCCCAGACTGAGCACGTGAGTTTTAGA GCTAGAAATAGCAAGTTAAAATAAGGC TAGTCCGTTATCAACTTGAAAAAGTGGC ACCGAGTCGGTGCTGGAGGAAGCAGGG CTTCCTTTCCTCTGCCATCATTCCAGTTT TAGAAGCTCCACATCGAAGACGAGAGT GGCATGTGGTGGGATGATGCCTGGGTGC CCAGTGGCACCATAGGCATAATCTGGAG ATATAGTCAGTTTGGCTCTCTGACCCAC ACTCATCTGGGCAACCCCTTCTTCCCAG CCTCGGATCACCTCCTGCTTGCCTAGCA TAAACTTAAAGGGCTTGTTTCTGTCCCG GGAGGAATCAAATTTCTTTCCATCTTCA AGCATCCGGTGTAGTGCACCACGCAGG TCTGGCCGCGCTTGGGGAAGGTGCGCCC GTCTCCTGGGGAGATGGTTTCCACCTGC ACTCCCGTGCTCAGTCTG (SEQ ID NO: 500) |
|---|---|

The target proteins for installing dimerization domains are not particularly limited; however, it is advantageous their dimerization (once modified by PE) in the presence of a bi-specific ligand produces some advantageous biological effect, e.g., a signaling pathway, decreased immunoresponsiveness, etc. In various aspects, the target proteins that are to be dimerized through the PE-dependent installation of dimerization domains can be the same protein or different proteins. Preferably, the proteins, when dimerized, trigger one or more downstream biological cascades, e.g., a signal transduction cascade, phorsphorylation, etc. Exemplary target proteins into which PE may be used to install dimerization domains, include, but are not limited to:

| MEMBRANDE-BOUND RECEPTOR | KINASE DOMAIN FUSED TO | CID EMPLOYED | SIGNALING CASCADE | REFERENCE |
|---|---|---|---|---|
| T-CELL RECEPTOR | FKBP12 | FK1012 (FK506 DIMER) | T-CELL RECEPTOR SIGNALING | *SCIENCE* 262, 1019-24 (1993) *CHEM. BIOL.* 1, 163-172 (1994). |
| FAS RECEPTOR | MURINE CYCLOPHILIN C | CYCLOSPORIN A DIMER | FAS PATHWAY FOR APOPTOSIS | *CHEM. BIOL.* 3, 731-738 (1996). |
| INSULIN RECEPTOR | FKBP12 | FK1012 (FK506 DIMER) | INSULIN SIGNALING | *CURR. BIOL.* 8, 11-18 (1998). |
| PLATELET-DERIVED GROWTH FACTOR (PDGF) BETA | FKBP12 | FK1012 (FK506 DIMER) | PDGF MESODERM FORMATION SIGNALING | *CURR. BIOL.* 8, 11-18 (1998). |
| ERYTHROPOIETIN RECEPTOR (EPOR) | FKBP12 | FK1012 (FK506 DIMER) | EPORMEDIATED PROLIFERATIVE SIGNALING | *PROC. NATL. ACAD. SCI.* 94, 3076-3081 (2002). |

-continued

| | AGAAAUUUGAUUCCUCCCGGGACAGAAA CAAGCCCUUUAAGUUUAUGCUAGGCAAG CAGGAGGUGAUCCGAGGCUGGGAAGAAG GGGUUGCCCAGAUGAGUGUGGGUCAGA GAGCCAAACUGACUAUAUCUCCAGAUUA UGCCUAUGGUGCCACUGGGCACCCAGGC AUCAUCCCACCACAUGCCACUCUCGUCU UCGAUGUGGAGCUUCUAAAACUGGAAUA ACAGUGCCUACC (SEQ ID NO: 499) |
|---|---|

In one aspect, prime editors described herein may be used to install sequences encoding dimerization domains into one or more genes encoding target proteins of interest in a living cell or patient. This may be referred to as the "prime editing-CID system," wherein the CID is the bi-specific ligand that induced dimerization of target proteins, each fused to a dimerization domain installed by PE. This edit alone should have no physiological effect. Upon administration of a bi-specific ligand, which typically is a dimeric small molecule that can simultaneously bind to two dimerization domain each of which is fused to a copy of the target protein, the bi-specific ligand causes dimerization of the targeted protein. This target protein dimerization event then induces a biological signaling event, such as erythropoiesis or insulin signaling. A new method to place dimerization-induced biological processes, such as receptor signaling, under control of a convenient small-molecule drug (i.e., the bi-specific ligand) by the genomic integration of genes encoding small-molecule binding proteins (i.e., the dimerization domains) with prime editing is described herein.

Protein dimerization is a ubiquitous biological process. Notably, homodimerization of many membrane-bound receptors is known to initiate signaling cascades, often with profound biological consequences. A number of small-molecule natural products approved for use as drugs act as chemical inducers of protein dimerization as part of their mechanism of action.[92] For example, FK506 binds tightly to FKBP12, and the resulting small molecule-protein complex then binds the phosphatase calcineurin, thereby inhibiting a step in T cell receptor signaling.[93] Likewise, cyclosporin A induces dimerization of cyclophilin and calcineurin, and rapamycin induces dimerization of FKBP and mTOR.[93,94]

In one embodiment, leveraging the selective, high-affinity binding of the FK506:FKBP12 and cyclosporin A:cyclophilin small molecule:protein binding interaction, synthetic chemical inducers of dimerization have also been developed. In an example, a small molecule comprised of two units of FK506, termed FK1012, was shown to effect signal transduction when the cytoplasmic domains of signaling receptors were tagged with FKBP12.[95] Chemical inducers of dimerization (CIDs) have since been used to control a number of signaling pathways.[96-103]

While useful tools for studying biological processes, one challenge facing synthetic CIDs for therapeutic applications is that introduction of the FKBP12- or cyclophilin-target protein chimeras into patients is challenging.

The present disclosure brings together two concepts to create a previously inaccessible therapeutic process. The first concept is prime editing, described herein, which allows for precise genome editing, including targeted insertions, in living cells. The second concept is chemical-induced dimerization, a powerful tool that has enabled small-molecule control over signaling and oligomerization processes in cell culture.

Specific cases in which chemical control over protein dimerization may have had a beneficial therapeutic effect have been identified.

The insulin receptor is a heterotetrameric transmembrane protein that responds to insulin binding to the extracellular domain by phosphorylation of the cytoplasmic kinase domain.[104] An engineered chimeric protein composed of a membrane-localization component, the C-terminal kinase domain of the insulin receptor, and three copies of FKBP12 responds to FK1012 and initiates the insulin response in cell culture.[99] Similarly, it is expected that the fusion of FKBP12 to the C-terminal end of the kinase domain of the native insulin receptor in patient cells should allow for FK1012-dependent phosphorylation and initiation of the insulin signaling cascade. This system could replace or complement insulin use in patients who cannot make insulin (e.g., type-1 diabetics), or who respond weakly to insulin (e.g., type-2 diabetics).

Additionally, erythropoietin stimulates erythrocyte proliferation by binding to the erythropoietin receptor (EpoR), either inducing dimerization or a conformational change in a preformed receptor dimer which results in activation of the Jak/STAT signaling cascade.[105] It has been demonstrated that FK1012-induced oligomerization of the membrane-anchored cytoplasmic domain of EpoR tagged with FKBP12 is sufficient to initiate the signaling Jak/STAT signaling cascade and promote cell proliferation.[106] It is anticipated that fusing FKBP12 to native EpoR by prime editing in patient cells will allow for FK1012-induced control over erythrocyte proliferation (erythropoiesis). This system could be used to trigger red blood cell growth in anemic patients. FK1012-inducible EpoR could also be employed as an in vivo selectable marker for blood cells that have undergone ex vivo engineering.

In principle, any receptor tyrosine kinase could be viable target for a prime editing-CID therapeutic. The table below includes a list of all receptor tyrosine kinases in the human genome.[110]

| Family | Receptor | Synonyms | NT Accession | PROT Accession | Chromosome |
|---|---|---|---|---|---|
| ALK family | ALK | Ki1 | NM_004304 | NP_004295 | 2p23 |
|  | LTK | TYK1 | NM_002344 | NP_002335 | 15q15.1-q21.1 |
| AXL family | AXL | UFO, Tyro7(r) Ark(m) | NM_001699 | NP_001690 | 19q13.1 |
|  | MER | MERTK, NYK, Eyk(ch) | NM_006343 | NP_006334 | 2q14.1 |
|  | TYRO3 | RSE, SKY, BRT, DTK, TIF | NM_006293 | NP_006284 | 15q15.1-q21.1 |
| DDR family | DDR1 | CAK, TRKE, NEP NTRK4, EDDR1, PTK3 | NM_013993 | NP_001945 | 6p21.3 |
|  | DDR2 | TKT, TYRO10, NTRKR3 | NM_006182 | NP_006173 | 1q21-q22 |
| EGFR family | EGFR | ERBB, ERBB1 | NM_005228 | NP_005219 | 7p12 |
|  | ERBB2 | HER2, Neu(r), NGL | NM_004448 | NP_004439 | 17q11.2-q12 |
|  | ERBB3 | HER3 | NM_001982 | NP_001973 | 12q13 |
|  | ERBB4 | HER4 | NM_005235 | NP_005226 | 2q33.3-q34 |
| EPH family | EPHA1 | EPH, EPHT | NM_005232 | NP_005223 | 7q32-q36 |
|  | EPHA2 | ECK, Sek(m), Myk2(m) | NM_004431 | NP_004422 | 1p34 |
|  | EPHA3 | HEK, ETK1, Tyro4(r), Mek4(m), Cek4(ch) | NM_005233 | NP_005224 | 3p11.2 |
|  | EPHA4 | HEK8, Tyrol(r), Sek1(m), Cek8(ch) | NM_004438 | NP_004429 | 2q36qter |
|  | EPHA5 | HEK7, Ehk(r), Bsk(r), Cek7(ch) | L36644 | P54756 |  |
|  | EPHA6 | DKFZp434C1418, Ehk2(r) | AL133666 |  |  |
|  | EPHA7 | HEK11, Mdk1(m), Ebk(m), Ehk3(r), Cek11(ch) | NM_004440 | NP_004431 | 6q21 |
|  | EPHA8 | HEK3, KIAA1459, Eek(r), Cek10(ch) | AB040892 | CAB81612 | 1q23-q24 |
|  | EPHB1 | NET, EPHT2, HEK6, Elk(r), Cek6(ch) | NM_004441 | NP_004432 | 3q21-q23 |
|  | EPHB2 | HEK5, ERK, DRT, EPHT3, Tyro5(r), Nuk(m), Sek3(m), Cek5(ch) | AF025304 | AAB94602 | 1p36.1-p35 |
|  | EPHB3 | HEK2, Tyro6, Mdk5(m), Sek4(m) | NM_004443 | NP_004434 | 3q21-qter |
|  | EPHB4 | HTK, Tyro11(r), Mdk2(m), Myk1(m) | NM_004444 | NP_004435 |  |
|  | EPHB6 | HEP, Mep(m), Cek1(ch) | NM_004445 | NP_004436 | 7q33-q35 |

-continued

| Family | Receptor | Synonyms | NT Accession | PROT Accession | Chromosome |
|---|---|---|---|---|---|
| FGFR family | FGFR1 | FLT2, bFGFR, FLG, N-SAM | M34641 | AAA35835 | 8p11.2 |
|  | FGFR2 | KGFR, K-SAM, Bek(m), CED1, JWS, Cek3(ch) | NM_000141 | NP_000132 | 10q26 |
|  | FGFR3 | HBGFR, ACH, Cek2(ch) | NM_000142 | NP_000133 | 4p16.3 |
|  | FGFR4 |  | NM_002011 | NP_002002 | 5q35.1-qter |
| INSR family | IGF1R | JTK13 | NM_000875 | NP_000866 | 15q25-q26 |
|  | INSR | IR | NM_000208 | NP_000199 | 19p13.3-p13.2 |
|  | INSRR | IRR | J05046 | AAC31759 | 1q21-q23 |
| MET Family | MET | HGFR | NM_000245 | NP_000236 | 7q31 |
|  | RON | MST1R, CDw136, Fv2(m), STK(m), SEA(ch) | NM_002447 | NP_002438 | 3p21.3 |
| MUSK family | MUSK | Nsk2(m), Mlk1(m), Mk2(m) | NM_005592 | NP_005583 | 9q31.3-q32 |
| PDGFR family | CSF1R | FMS, C-FMS, CD115 | NM_005211 | NP_005202 | 5q31-q32 |
|  | FLT3 | FLK2, STK1, CD135 | NM_004119 | NP_0041110 | 13q12 |
|  | KIT | Sfr(m), CKIT | NM_000222 | NP_000213 | 4q11-q12 |
|  | PDGFRA |  | NM_006206 | NP_006197 | 4q11-q13 |
|  | PDGFRB | PDGFR, JTK12 | NM_002609 | NP_002600 | 5q31-q32 |
| PTK7 family | PTK7 | CCK4, KLG(ch) | NM_002821 | NP_002812 | 6p21.2-p12.2 |
| RET family | RET | MEN2A/B, HSCR1, MTC1 | X12949 | P07949 | 10q11.2 |
| ROR family | ROR1 | NTRKR1 | NM_005012 | NP_005003 | 1p32-p31 |
|  | ROR2 | NTRKR2 | NM_004560 | NP_004551 |  |
| ROS family | ROS1 | MCF3 | NM_002944 | NP_002935 | 6q22 |
| RYK family | RYK | Vlk(m), Mrk(m) | S59184 | AAB263411 | 3q22 |
| TIE family | TEK | TIE2 | NM_000459 | NP_000450 | 9p21 |
|  | TIE | TIE1, JTK14 | NM_005424 | NP_005415 | 1p34-p33 |
| TRK family | NTRK1 | TRK, TRKA | NM_002529 | NP_002520 | 1q21-q22 |
|  | NTRK2 | TRKB | NM_006180 | NP_006171 | 9q22.1 |
|  | NTRK3 | TRKC | NM_002530 | NP_002521 | 15q25 |
| VEGFR family | VEGFR1 | FLT1 | NM_002019 | NP_002010 | 13q12 |
|  | VEGFR2 | KDR, FLK1 |  | AAB88005 | 4q11-q12 |
|  | VEGFR3 | FLT4, PCL | NM_002020 | NP_002011 | 5q34-q35 |
| AATYK family | AATYK | AATK, KIAA0641 | NM_004920 | NP_004911 | 17q25.3 |
|  | AATYK2 | KIAA1079 | NM_014916 | NP_055731 | 7q21-q22 |
|  | AATYK3 |  |  |  | 19q13.2-ql3.3 |

There are numerous advantages to the prime editing-CID system. One such advantage is that it can replace endogenous ligands, which are typically proteins that pose complications in manufacturing, cost, delivery, production, or storage, with drug-like small-molecules that can be orally administered instead of administered by IV or injection, are readily prepared from FDA-approved drugs (or are themselves already drugs), and do not incur special production or storage costs typically associated with protein drugs. Another advantage is that the edit alone should have no physiological effect. The amount of target protein dimerization can be controlled by dosing the small-molecule CID. Further, target protein dimerization is readily and rapidly reversible by adding the monomeric form of the CID. Yet another advantage is that in instances where a single ligand targets multiple receptors, selectivity can be achieved by prime-editing only one receptor. Finally, depending on the delivery method used for prime editing, it may also be possible to restrict editing to a localized tissue or organ, allowing for inducible receptor activation only in specific areas.

If editing efficiencies are high enough with prime editing that two separate editing events could occur at high levels, it would also be possible to tag two proteins of interest with different small-molecule binding domains (such as FKBP and cyclophilin) and induce heterodimerizations with small molecule heterodimers (such as an FK506-cyclosporin A dimer).

The fusion of FKBP12 or other small-molecule binding proteins to native proteins has been accomplished, generally by overexpression from plasmid in tissue culture. Subsequent chemical-induced dimerization has been demonstrated to induce phenotypic changes to cells producing the fusion proteins.

The following references are cited above in the Section G and are incorporated herein by reference.
1. Crabtree, G. R. & Schreiber, S. L. Three-part inventions: intracellular signaling and induced proximity. *Trends Biochem. Sci.* 21, 418-22 (1996).
2. Liu, J. et al. Calcineurin Is a Common Target of A and FKBP-FK506 Complexes. *Cell* 66, 807-815 (1991).
3. Keith, C. T. et al. A mammalian protein targeted by G1-arresting rapamycin-receptor complex. *Nature* 369, 756-758 (2003).
4. Spencer, D. M., Wandless, T. J., Schreiber, S. L. S. & Crabtree, G. R. Controlling signal transduction with synthetic ligands. *Science* 262, 1019-24 (1993).
5. Pruschy, M. N. et al. Mechanistic studies of a signaling pathway activated by the organic dimerizer FK1012. *Chem. Biol.* 1, 163-172 (1994).
6. Spencer, D. M. et al. Functional analysis of Fas signaling in vivo using synthetic inducers of dimerization. *Curr. Biol.* 6, 839-847 (1996).
7. Belshaw, P. J., Spencer, D. M., Crabtree, G. R. & Schreiber, S. L. Controlling programmed cell death with a cyclophilin-cyclosporin-based chemical inducer of dimerization. *Chem. Biol.* 3, 731-738 (1996).
8. Yang, J. X., Symes, K., Mercola, M. & Schreiber, S. L. Small-molecule control of insulin and PDGF receptor signaling and the role of membrane attachment. *Curr. Biol.* 8, 11-18 (1998).
9. Belshaw, P. J., Ho, S. N., Crabtree, G. R. & Schreiber, S. L. Controlling protein association and subcellular localization with a synthetic ligand that induces heterodimerization of proteins. *Proc. Natl. Acad. Sci.* 93, 4604-4607 (2002).

10. Stockwell, B. R. & Schreiber, S. L. Probing the role of homomeric and heteromeric receptor interactions in TGF-β signaling using small molecule dimerizers. *Curr. Biol.* 8, 761-773 (2004).
11. Spencer, D. M., Graef, I., Austin, D. J., Schreiber, S. L. & Crabtree, G. R. A general strategy for producing conditional alleles of Src-like tyrosine kinases. *Proc. Natl. Acad. Sci.* 92, 9805-9809 (2006).
12. Holsinger, L. J., Spencer, D. M., Austin, D. J., Schreiber, S. L. & Crabtree, G. R. Signal transduction in T lymphocytes using a conditional allele of Sos. *Proc. Natl. Acad. Sci.* 92, 9810-9814 (2006).
13. Myers, M. G. Insulin Signal Transduction and the IRS Proteins. *Annu. Rev. Pharmacol. Toxicol.* 36, 615-658 (1996).
14. Watowich, S. S. The erythropoietin receptor: Molecular structure and hematopoietic signaling pathways. *J. Investig. Med.* 59, 1067-1072 (2011).
15. Blau, C. A., Peterson, K. R., Drachman, J. G. & Spencer, D. M. A proliferation switch for genetically modified cells. *Proc. Natl. Acad. Sci.* 94, 3076-3081 (2002).
16. Clackson, T. et al. Redesigning an FKBP-ligand interface to generate chemical dimerizers with novel specificity. *Proc. Natl. Acad. Sci.* 95, 10437-10442 (1998).
17. Diver, S. T. & Schreiber, S. L. Single-step synthesis of cell-permeable protein dimerizers that activate signal transduction and gene expression. *J. Am. Chem. Soc.* 119, 5106-5109 (1997).
18. Guo, Z. F., Zhang, R. & Liang, F. Sen. Facile functionalization of FK506 for biological studies by the thiol-ene 'click' reaction. *RSC Adv.* 4, 11400-11403 (2014).
19. Robinson, D. R., Wu, Y.-M. & Lin, S.-F. The protein tyrosine kinase family of the human genome. Oncogene 19, 5548-5557 (2000).

L. Use of Prime Editing for Cell Data Recording

The prime editors and the resulting genomic modifications can also be used to study and record cellular processes and development. For example, the prime editors described herein may be used to record the presence and duration of a stimulus to a cell by providing to the cell a first nucleic acid sequence that encodes a fusion protein with a nucleic acid programmable DNA binding protein (napDNAbp) and a reverse transcriptase, and providing the cell at least a second nucleic acid sequence that encodes a PEgRNA. Either the first, the second, or both nucleic acid sequences are operably linked to inducible promoters that are responsive to the cell stimulus such that it induces expression of the fusion protein and/or the PEgRNA thereby causing the modification of a target sequence within the cell.

The prime editors described herein can also be used for cellular barcoding and lineage tracing. For example, by barcoding each cell with a unique genomic barcode, the prime editor can help reveal the cell lineage map by allowing the construction of phylogenetic trees based on the modifications made in one or more target sequence. Starting from progenitor cells, the prime editor system can enable building a cell-fate map for single cells in a whole organism, which can be deciphered by analyzing the modifications made in one or more target sequence. The method for tracing the linage of cells can include providing a nucleic acid encoding a fusion protein with a napDNAbp and a reverse transcriptase, and providing at least one second nucleic acid encoding a PEgRNA. A unique cellular barcode can be generated using the fusion protein and the PEgRNA to create one or more modifications in one or more target sequence, thereby allowing the linage of any cell that arises from the first cell to be traced using the unique cellular barcode. The use of prime editors for both cell data recording and linage tracing is further described in Example 13.

The prime editors can do perform both lineage tracing and cellular signaling recording by modifying genomic target sequences or integrated pre-designed sequences. Prime editors use a synthetic fusion protein comprising a Cas9 nickase fragment (including but not limited to the SpCas9 H840A variant) and a reverse transcriptase domain, along with an engineered prime editing guide RNA (PEgRNA). Together, these components target a specific genomic sequence or integrated pre-designed sequence and install a pre-determined edit. Because the PEgRNA specifies both the target genomic sequence and the edited outcome, highly specific and controlled genome modification can be achieved simultaneously using multiple PEgRNA within the same cell. Accessible genome modifications include all single nucleotide substitutions, small- to medium-sized sequence insertions, and small- to medium-sized deletions. The versatility of this genome editing technology can enable temporally coupled, signal-specific recording within cells.

The use of prime editors for cell data recording can include compositions (e.g., nucleic acids), cells, systems, kits, and methods for recording the strength and/or duration of endogenous or exogenous stimuli over the course of a cell's lifetime. The cell data recording system can include a fusion protein consisting of a napDNAbp (e.g., a Cas9 domain) and a reverse transcriptase operably linked to a promoter that induces the expression of the fusion protein to induce changes by creating targeted and sequence-specified genomic insertions, deletions, or mutations in response to a stimulus or change in the cell. In contrast to digital memory devices that store information (e.g., the presence or absence of a stimulus) in one of two distinct states (i.e., "on" or "off"), these cell data recorders can induce permanent marks in cellular DNA in a manner that reflects both the strength (i.e., amplitude) and duration of one or more stimuli. Thus, in some aspects, cell data recording systems have the ability to simultaneously record multiple cell states, including, for example, exposure to a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism. These cell data recorders can employ sequencing technologies (e.g., high-throughput sequencing) to measure readout (e.g., changes in cellular DNA) and are not dependent on large cell populations for both the recording of a stimulus or the readout of the change(s) in cellular DNA induced by the stimulus.

In general, the cell data recorder systems provided herein for use in a cell comprise a fusion protein consisting of a napDNAbp and a reverse transcriptase, wherein the nucleic acid sequence encoding the fusion plasmid is operably linked to a promoter (e.g., an inducible promoter or a constitutive promoter). When a stimulus is present, or a change in cell state occurs, the stimulus induces the expression of the fusion protein. Also present within the cell are one or more nucleic acids encoding at least one PEgRNA that associate with the napDNAbp and directs the napDNAbp or the fusion protein to a target sequence (i.e., the PEgRNA is complementary to a target sequence). The nucleic acid encoding PEgRNA may also be, or may alternatively be, operably linked to a promoter (e.g., an inducible promoter or a constitutive promoter). Under the correct stimulus, or correct set of stimuli, both the fusion protein and the PEgRNA are expressed in the cell, and the PEgRNA associates with the fusion protein to direct it to a target sequence. This target sequence records the activity of the prime editor, thereby recording the presence of a stimulus, or a set of stimuli, or a change in cell state. More than one PEgRNA sequence can also be present in the cell, and these additional PEgRNA sequences, which can direct the fusion protein to distinct target sequences, can each be operably linked to a promoter that senses the presence of a different stimulus, allowing complex cell data recorder systems to be constructed for the ordered recording of the presence and duration of a stimulus, or set of stimuli. In some cases, one or more of the components of the cell data recorder system (e.g., fusion protein and PEgRNA) may be constitutively expressed in the cell. Exemplary components of the cell data recorder system for use with the compositions are described herein. Additional suitable combinations of components provided herein will be apparent to a person of ordinary skill in the art based on this disclosure and knowledge in the field, and thus are embraced by the scope of this disclosure.

Repeated modification of a DNA target that can be sequenced by targeted amplicon sequencing and/or RNA sequencing (which is particular value for single cell recording experiments) can be used to record a host of important biological processes, including activation of signaling cascades, metabolic states, and cellular differentiation programs. Connecting internal and external cellular signals to sequence modification in the genome is possible for any signal for which a signal responsive promotor exists. In some embodiments, the promoter is a promoter suitable for use in a prokaryotic system (i.e., a bacterial promoter). In some embodiments, the promoter is a promoter suitable for use in a eukaryotic system (i.e., a eukaryotic promoter). In some embodiments, the promoter is a promoter suitable for use in a mammalian (e.g., human) system (i.e., a mammalian promoter). In some embodiments, the promoter is induced by a stimulus (i.e., an inducible promoter). In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the stimulus is a light. In some embodiments, the stimulus is a virus. In some embodiments, the stimulus is a small molecule. In some embodiments, the stimulus is an antibiotic. In some embodiments, the stimulus is anhydrotetracycline or doxycycline. In some embodiments, the stimulus is a sugar. In some embodiments, the stimulus is arabinose, rhamnose, or IPTG. In some embodiments, the stimulus is a signaling molecule produced during an activated signaling cascade (e.g., beta-catenin produced during an activated Wnt signaling cascade). Additional promoters that detect signaling molecules can be generated to induce the expression of the nucleic acid sequence operably linked to the promoter, for example, promoters that record an endogenous pathway, including immune response (IL-2 promoter), a cAMP responsive element (CREB), NFκB signaling, interferon response, P53 (DNA damage), Sox2, TGF-β signaling (SMAD), Erk (e.g., from an activated Ras/Raf/Mek/Erk cascade), PI3K/AKT (e.g., from an activated Ras/PI3K/Akt cascade), heat shock, Notch signaling, Oct4, an aryl hydrocarbon receptor, or an AP-1 transcription factor. In some embodiments, the promoter is a constitutive promoter. In some embodiments, the promoter is a promoter listed in Table 3. Additional suitable promoters for use in both prokaryotic and eukaryotic systems will be apparent to those of ordinary skill in the art based on this disclosure and knowledge in the field, and are within the scope of the present disclosure.

Prime editors can also be used to trace cellular lineages. Repeated sequence modifications can be used to generate unique cellular barcodes to track individual cells. The arrays of barcodes, their order, and size can all be used to infer cellular lineages. For example, the insertion of homology sequences (i.e., sequences 3' of the Cas9 nick location), and in particular homology sequences with associated barcodes, appear to be particularly useful lineage prime editor strategies. These systems can be designed such that successive rounds of editing result in the insertion of a barcode from a PEgRNA cassette that cannot be modified by other PEgRNA editing events in the same cell. The barcoding system can utilize multiple barcodes that can be associated with a given stimulus. This system can preserve the majority of the target protospacers but alter the seed sequence, PAM, and downstream adjacent nucleotides. This enables multiple signals to be connected to one editing locus without significant re-designing of the PEgRNAs being used. The strategy can enable multiplexed barcode insertions in response to a large number of cellular stimuli (either internal or external) at a single locus. It could enable the recording of intensity, duration, and order of as many signals as there exist unique barcodes (which can be designed with multiple N nucleotides to generate 4^N possible barcodes, for example a 5-nt barcode would enable recording of 4^5 or 1024 unique signals at once). This system can be used both in vitro and in vivo.

M. Use of Prime Editing to Modulate Biomolecule Activity

The use of prime editors described herein may also be used to regulate the subcellular localization and modification states of biomolecules, such as DNA, RNA, and proteins. Specific biological functions, like transcriptional control, cellular metabolism, and signal transduction cascades, are carefully orchestrated in particular locations within the cell. The ability to traffic proteins to these and other unique cellular compartments could provide an opportunity to alter a number of biological processes.

Accordingly, prime editing can be used to install genetically encoded handles that will allow for altered modification states and the subcellular trafficking of biomolecules with a genetically encoded signal (e.g. proteins, lipids, sugars, and nucleic acids). In various embodiments, the target biomolecules for prime editor-mediated medication are DNA. For example, DNA could be modified by installing a number of DNA sequences that change the accessibility of the target locus, which could lead to either increased or decreased transcription of desired sequences. In other embodiments, the target biomolecules for prime editor-mediated medication are RNA. For example, the activity of RNA can be modified by changing its cellular localization, interacting partners, structural dynamics, or thermodynamics of folding. In yet other embodiments, the target biomolecules for prime editor-mediated medication are protein. Proteins can be modified to impact post-translational modifications, protein motifs can be installed to change the subcellular localization of the protein, or proteins can be modified to either create or destroy their ability to exist within protein-protein complexation events.

This application of prime editing can be further described in Example 14.

DNA Modifications

One target biomolecule for PE-mediated modification is DNA. Modifications to DNA could be made to install a number of DNA sequences that change the accessibility of the target locus. Chromatin accessibility controls gene transcriptional output. Installation of marks to recruit chromatin compacting enzymes should decrease the transcriptional output of neighboring genes, while installation of sequences associated with chromatin opening should make regions more accessible and in turn increase transcription. Installation of more complex sequence motifs that mirror native regulatory sequences should provide more nuanced and biologically sensitive control than the currently available dCas9 fusions to different epigenetic reader, writer, or eraser enzymes—tools that typically install large numbers of a single type of mark that may not have a particular biological antecedent. Installation of sequences that will bring two loci into close proximity, or bring loci into contact with the nuclear membrane, should also alter the transcriptional output of those loci as has been demonstrated in the burgeoning field of 3-D genomic architecture.

RNA Modifications

Modifications to RNAs can also be made to alter their activity by changing their cellular localization, interacting partners, structural dynamics, or thermodynamics of folding. Installation of motifs that will cause translational pausing or frameshifting could change the abundance of mRNA species through various mRNA processing mechanisms. Modifying consensus splice sequences would also alter the abundance and prevalence of different RNA species. Changing the relative ratio of different splice isoforms would predictably lead to a change in the ratio of protein translation products, and this could be used to alter many biological pathways. For instance, shifting the balance of mitochondrial versus nuclear DNA repair proteins would alter the resilience of different cancers to chemotherapeutic reagents. Furthermore, RNAs could be modified with sequences that enable binding to novel protein targets. A number of RNA aptamers have been developed that bind with high affinity to cellular proteins. Installation of one of these aptamers could be used to either sequester different RNA species through binding to a protein target that will prevent their translation, biological activity, or to bring RNA species to specific subcellular compartments. Biomolecule degradation is another class of localization modification.

For example, RNA methylation is used to regulate RNAs within the cell. Consensus motifs for methylation could be introduced into target RNA coding sequences with PE. RNAs could also be modified to include sequences that direct nonsense mediated decay machinery or other nucleic acid metabolism pathways to degrade the target RNA species would change the pool of RNAs in a cell. Additionally, RNA species could be modified to alter their aggregation state. Sequences could be installed on single RNAs of interest or multiple RNAs to generate RNA tangles that would render them ineffective substrates for translation or signaling.

Protein Modifications

Modifications to proteins via post-translational modification (PTM) also represent an important class of biomolecule manipulation that can be carried out with PE. As with RNA species, changing the abundance of proteins in a cell is an important capability of PE. Editing can be done to install stop codons in an open reading frame—this will eliminate full-length product from being produced by the edited DNA sequence. Alternatively, peptide motifs can be installed that cause the rate of protein degradation to be altered for a target protein. Installation of degradation tags into a gene body could be used to alter the abundance of a protein in a cell. Moreover, introduction of degrons that are induced by small molecules could enable temporal control over protein degradation. This could have important implications for both research and therapeutics as researchers could readily assess whether small molecule-mediated therapeutic protein degradation of a given target was a viable therapeutic strategy. Protein motifs could also be installed to change the subcellular localization of a protein. Amino acid motifs can be installed to preferentially traffic proteins to a number of subcellular compartments including the nucleus, mitochondria, cell membrane, peroxisome, lysosome, proteasome, exosome, and others.

Installing or destroying motifs modified by PTM machinery can alter protein post-translational modifications. Phosphorylation, ubiquitylation, glycosylation, lipidation (e.g. farnesylation, myristoylation, palmitoylation, prenylation, GPI anchors), hydroxylation, methylation, acetylation, crotonylation, SUMOylation, disulfide bond formations, side chain bond cleavage events, polypeptide backbone cleavage events (proteolysis), and a number of other protein PTMs have been identified. These PTMs change protein function, often by changing subcellular localization. Indeed, kinases often activate downstream signaling cascades via phosphorylation events. Removal of the target phosphosite would prevent signal transduction. The ability to site-specifically ablate or install any PTM motif while retaining full-length protein expression would be an important advance for both basic research and therapeutics. The sequence installation scope and target window of PE make it well suited for broad PTM modification space.

Removal of lipidation sites should prevent the trafficking of proteins to cell membranes. A major limitation to current therapeutics that target post-translational modification processes is their specificity. Farnesyl transferase inhibitors have been tested extensively for their ability to eliminate KRAS localization at cell membranes. Unfortunately, global inhibition of farnesylation comes with numerous off target effects that have prevented broad use of these small molecules. Similarly, specific inhibition of protein kinases with small molecules can be very challenging due to the large size of the human genome and similarities between various kinases. PE offers a potential solution to this specificity problem, as it enables inhibition of modification of the target protein by ablation of the modification site instead of global enzyme inhibition. For example, removal of the lapidated peptide motif in KRAS would be a targeted approach that could be used in place of farnesyl transferase inhibition. This approach is the functional inverse of inhibiting a target protein activity by installing a lipid-targeting motif on a protein not designed to be membrane bound.

PE can also be used to instigate protein-protein complexation events. Proteins often function within complexes to execute their biological activity. PE can be used to either create or destroy the ability of proteins to exist within these complexes. To eliminate complex formation events, amino acid substitutions or insertions along the protein: protein interface could be installed to disfavor complexation. SSX18 is a protein component of the BAF complex, an important histone-remodeling complex. Mutations in SSX18 drive synovial sarcomas. PE could be used to install side chains that prevent SSX18 from binding to its protein partners in the complex to prevent its oncogenic activity. PE could also be used to remove the pathogenic mutations to restore WT activity of this protein. Alternatively, PE could be used to keep proteins within either their native complex or to drag them to participate in interactions that are unrelated to their native activity to inhibit their activity. Forming complexes that maintain one interaction state over another could represent an important therapeutic modality. Altering protein: protein interfaces to decrease the Kd of the interaction would keep those proteins stuck to one another longer. As protein complexes can have multiple signaling complexes, like n-myc driving neuroblastoma signaling cascades in disease but otherwise participating in healthy transcriptional control in other cells. PE could be used to install mutations that drive n-myc association with healthy interactions partners and decrease its affinity for oncogenic interaction partners.

References Cited in Section I

Each of the following references are incorporated herein by reference.
1. Selective Target Protein Degradation via Phthalimide Conjugation. Winter et al. Science. Author manuscript; available in PMC 2016 Jul. 8.
2. Reversible disruption of mSWI/SNF (BAF) complexes by the SS18-SSX oncogenic fusion in synovial sarcoma. Kadoch and Crabtree. Cell. 2013 Mar. 28; 153(1):71-85. doi: 10.1016/j.cell.2013.02.036.
3. Ribosomal frameshifting and transcriptional slippage: From genetic steganography and cryptography to adventitious use. Atkins et al. Nucleic Acids Research, Volume 44, Issue 15, 6 Sep. 2016, *Pages* 7007-7078.
4. Transcriptional Regulation and its Misregulation in Disease. Lee and Young. Cell. Author manuscript; available in PMC 2014 Mar. 14.
5. Protein localization in disease and therapy. Mien-Chie Hung, Wolfgang Link Journal of Cell Science 2011 124: 3381-3392.
6. Loss of post-translational modification sites in disease. Li et al. Pac Symp Biocomput. 2010:337-47. PTMD: A Database of Human Disease-associated Post-translational Modifications. Xu et al. Genomics Proteomics Bioinformatics. 2018 August; 16(4):244-251. Epub 2018 Sep. 21.
7. Post-transcriptional gene regulation by mRNA modifications. Zhao et al. Nature Reviews Molecular Cell Biology volume 18, pages 31-42 (2017).

N. Improved Design Aspects of PEgRNAs for Prime Editing

In other embodiments, the prime editing system may include the use of PEgRNA designs and strategies that can improve prime editing efficiency. These strategies seek to overcome some issues that exist because of the multi-step process required for prime editing. For example, unfavorable RNA structures that can form within the PEgRNA can result in the inhibition of DNA edits being copied from the PEgRNA into the genomic locus. These limitations could be overcome through the redesign and engineering of the PEgRNA component. These redesigns could improve prime editor efficiency, and could allow the installation of longer inserted sequences into the genome.

Accordingly, in various embodiments, the PEgRNA designs can result in longer PEgRNAs by enabling efficient expression of functional PEgRNAs from non-polymerase III (pol III) promoters, which would avoid the need for burdensome sequence requirements. In other embodiments, the core, Cas9-binding PEgRNA scaffold can be improved to improve efficacy of the system. In yet other embodiments, modifications can be made to the PEgRNA to improve reverse transcriptase (RT) processivity, which would enable the insertion of longer sequences at the targeted genomic loci. In other embodiments, RNA motifs can be added to the 5' and/or 3' termini of the PEgRNA to improve stability, enhance RT processivity, prevent misfolding of the PEgRNA, and/or recruit additional factors important for genome editing. In yet another embodiment, a platform is provided for the evolution of PEgRNAs for a given sequence target that could improve the PEgRNA scaffold and enhance prime editor efficiency. These designs could be used to improve any PEgRNA recognized by any Cas9 or evolved variant thereof.

This application of prime editing can be further described in Example 15.

The PEgRNAs may include additional design improvements that may modify the properties and/or characteristics of PEgRNAs thereby improving the efficacy of prime editing. In various embodiments, these improvements may belong to one or more of a number of different categories, including but not limited to: (1) designs to enable efficient expression of functional PEgRNAs from non-polymerase III (pol III) promoters, which would enable the expression of longer PEgRNAs without burdensome sequence requirements; (2) improvements to the core, Cas9-binding PEgRNA scaffold, which could improve efficacy; (3) modifications to the PEgRNA to improve RT processivity, enabling the insertion of longer sequences at targeted genomic loci; and (4) addition of RNA motifs to the 5' or 3' termini of the PEgRNA that improve PEgRNA stability, enhance RT processivity, prevent misfolding of the PEgRNA, or recruit additional factors important for genome editing.

In one embodiment, PEgRNA could be designed with polIII promoters to improve the expression of longer-length PEgRNA with larger extension arms. sgRNAs are typically expressed from the U6 snRNA promoter. This promoter recruits pol III to express the associated RNA and is useful for expression of short RNAs that are retained within the nucleus. However, pol III is not highly processive and is unable to express RNAs longer than a few hundred nucleotides in length at the levels required for efficient genome editing. Additionally, pol III can stall or terminate at stretches of U's, potentially limiting the sequence diversity that could be inserted using a PEgRNA. Other promoters that recruit polymerase II (such as pCMV) or polymerase I (such as the U1 snRNA promoter) have been examined for their ability to express longer sgRNAs. However, these promoters are typically partially transcribed, which would result in extra sequence 5' of the spacer in the expressed PEgRNA, which has been shown to result in markedly reduced Cas9:sgRNA activity in a site-dependent manner. Additionally, while pol III-transcribed PEgRNAs can simply terminate in a run of 6-7 U's, PEgRNAs transcribed from pol II or pol I would require a different termination signal. Often such signals also result in polyadenylation, which would result in undesired transport of the PEgRNA from the nucleus. Similarly, RNAs expressed from pol II promoters such as pCMV are typically 5'-capped, also resulting in their nuclear export.

Previously, Rinn and coworkers screened a variety of expression platforms for the production of long-noncoding RNA-(lncRNA) tagged sgRNAs[183]. These platforms include RNAs expressed from pCMV and that terminate in the ENE element from the MALAT1 ncRNA from humans[184], the PAN ENE element from KSHV[185], or the 3' box from U1 snRNA[186]. Notably, the MALAT1 ncRNA and PAN ENEs form triple helices protecting the polyA-tail[184, 187]. These constructs could also enhance RNA stability. It is contemplated that these expression systems will also enable the expression of longer PEgRNAs.

In addition, a series of methods have been designed for the cleavage of the portion of the pol II promoter that would be transcribed as part of the PEgRNA, adding either a self-cleaving ribozyme such as the hammerhead[188], pistol[189], hatchet[189], hairpin[190], VS[191], twister[192], or twister sister[192] ribozymes, or other self-cleaving elements to process the transcribed guide, or a hairpin that is recognized by Csy4[193] and also leads to processing of the guide. Also, it is hypothesized that incorporation of multiple ENE motifs could lead to improved PEgRNA expression and stability, as previously demonstrated for the KSHV PAN RNA and element[185]. It is also anticipated that circularizing the PEgRNA in the form of a circular intronic RNA (ciRNA) could also lead to enhanced RNA expression and stability, as well as nuclear localization[194].

In various embodiments, the PEgRNA may include various above elements, as exemplified by the following sequence.

Non-Limiting Example 1—PEgRNA Expression Platform Consisting of pCMV, Csy4 Hairpin, the PEgRNA, and MALAT1 ENE (SEQ ID NO: 501)
TAGTTATTAATAGTAATCAATTACGGGGTCATTAGTTCATAGCCCATATATGGAGTTC

CGCGTTACATAACTTACGGTAAATGGCCCGCCTGGCTGACCGCCCAACGACCCCC

GCCCATTGACGTCAATAATGACGTATGTTCCCATAGTAACGCCAATAGGGACTTTCC

ATTGACGTCAATGGGTGGAGTATTTACGGTAAACTGCCCACTTGGCAGTACATCAA

GTGTATCATATGCCAAGTACGCCCCCTATTGACGTCAATGACGGTAAATGGCCCGC

CTGGCATTATGCCCAGTACATGACCTTATGGGACTTTCCTACTTGGCAGTACATCTA

CGTATTAGTCATCGCTATTACCATGGTGATGCGGTTTTGGCAGTACATCAATGGGCG

TGGATAGCGGTTTGACTCACGGGGATTTCCAAGTCTCCACCCCATTGACGTCAATG

GGAGTTTGTTTTGGCACCAAAATCAACGGGACTTTCCAAAATGTCGTAACAACTC

CGCCCCATTGACGCAAATGGGCGGTAGGCGTGTACGGTGGGAGGTCTATATAAGC

AGAGCTGGTTTAGTGAACCGTCAGATCGTTCACTGCCGTATAGGCAGGGCCCAGA

CTGAGCACGTGAGTTTTAGAGCTAGAAATAGCAAGTTAAAATAAGGCTAGTCCGT

TATCAACTTGAAAAAGTGGGACCGAGTCGGTCCTCTGCCATCAAAGCGTGCTCAG

TCTGTTTTAGGGTCATGAAGGTTTTTCTTTTCCTGAGAAAACAACACGTATTGTTTT

CTCAGGTTTTGCTTTTTGGCCTTTTTCTAGCTTAAAAAAAAAAAAAGCAAAAGAT

GCTGGTGGTTGGCACTCCTGGTTTCCAGGACGGGGTTCAAATCCCTGCGGCGTCT

TTGCTTTGACT

Non-Limiting Example 2—PEgRNA Expression Platform Consisting of pCMV, Csy4 Hairing, the PEgRNA, and PAN ENE (SEQ ID NO: 502)
TAGTTATTAATAGTAATCAATTACGGGGTCATTAGTTCATAGCCCATATATGGAGTTC

CGCGTTACATAACTTACGGTAAATGGCCCGCCTGGCTGACCGCCCAACGACCCCC

GCCCATTGACGTCAATAATGACGTATGTTCCCATAGTAACGCCAATAGGGACTTTCC

ATTGACGTCAATGGGTGGAGTATTTACGGTAAACTGCCCACTTGGCAGTACATCAA

GTGTATCATATGCCAAGTACGCCCCCTATTGACGTCAATGACGGTAAATGGCCCGC

CTGGCATTATGCCCAGTACATGACCTTATGGGACTTTCCTACTTGGCAGTACATCTA

CGTATTAGTCATCGCTATTACCATGGTGATGCGGTTTTGGCAGTACATCAATGGGCG

TGGATAGCGGTTTGACTCACGGGGATTTCCAAGTCTCCACCCCATTGACGTCAATG

GGAGTTTGTTTTGGCACCAAAATCAACGGGACTTTCCAAAATGTCGTAACAACTC

CGCCCCATTGACGCAAATGGGCGGTAGGCGTGTACGGTGGGAGGTCTATATAAGC

AGAGCTGGTTTAGTGAACCGTCAGATCGTTCACTGCCGTATAGGCAGGGCCCAGA

-continued

CTGAGCACGTGAGTTTTAGAGCTAGAAATAGCAAGTTAAAATAAGGCTAGTCCGT

TATCAACTTGAAAAAGTGGGACCGAGTCGGTCCTCTGCCATCAAAGCGTGCTCAG

TCTGTTTTGTTTTGGCTGGGTTTTTCCTTGTTCGCACCGGACACCTCCAGTGACCA

GACGGCAAGGTTTTTATCCCAGTGTATATTGGAAAAACATGTTATACTTTTGACAAT

TTAACGTGCCTAGAGCTCAAATTAAACTAATACCATAACGTAATGCAACTTACAAC

ATAAATAAAGGTCAATGTTTAATCCATAAAAAAAAAAAAAAAAAAA

Non-Limiting Example 3—PEgRNA Expression Platform Consisting of pCMV, Csy4 Hairing, the PEgRNA, and 3xPAN ENE 15

(SEQ ID NO: 503)
TAGTTATTAATAGTAATCAATTACGGGGTCATTAGTTCATAGCCCATATATGGAGTTC

CGCGTTACATAACTTACGGTAAATGGCCCGCCTGGCTGACCGCCCAACGACCCCC

GCCCATTGACGTCAATAATGACGTATGTTCCCATAGTAACGCCAATAGGGACTTTCC

ATTGACGTCAATGGGTGGAGTATTTACGGTAAACTGCCCACTTGGCAGTACATCAA

GTGTATCATATGCCAAGTACGCCCCCTATTGACGTCAATGACGGTAAATGGCCCGC

CTGGCATTATGCCCAGTACATGACCTTATGGGACTTTCCTACTTGGCAGTACATCTA

CGTATTAGTCATCGCTATTACCATGGTGATGCGGTTTTGGCAGTACATCAATGGGCG

TGGATAGCGGTTTGACTCACGGGGATTTCCAAGTCTCCACCCCATTGACGTCAATG

GGAGTTTGTTTTGGCACCAAAATCAACGGGACTTTCCAAAATGTCGTAACAACTC

CGCCCCATTGACGCAAATGGGCGGTAGGCGTGTACGGTGGGAGGTCTATATAAGC

AGAGCTGGTTTAGTGAACCGTCAGATCGTTCACTGCCGTATAGGCAGGGCCCAGA

CTGAGCACGTGAGTTTTAGAGCTAGAAATAGCAAGTTAAAATAAGGCTAGTCCGT

TATCAACTTGAAAAAGTGGGACCGAGTCGGTCCTCTGCCATCAAAGCGTGCTCAG

TCTGTTTTGTTTTGGCTGGGTTTTTCCTTGTTCGCACCGGACACCTCCAGTGACCA

GACGGCAAGGTTTTTATCCCAGTGTATATTGGAAAAACATGTTATACTTTTGACAAT

TTAACGTGCCTAGAGCTCAAATTAAACTAATACCATAACGTAATGCAACTTACAAC

ATAAATAAAGGTCAATGTTTAATCCATAAAAAAAAAAAAAAAAAAAAACACACTGT

TTTGGCTGGGTTTTTCCTTGTTCGCACCGGACACCTCCAGTGACCAGACGGCAAG

GTTTTTATCCCAGTGTATATTGGAAAAACATGTTATACTTTTGACAATTTAACGTGC

CTAGAGCTCAAATTAAACTAATACCATAACGTAATGCAACTTACAACATAAATAAA

GGTCAATGTTTAATCCATAAAAAAAAAAAAAAAAAAATCTCTCTGTTTTGGCTGG

GTTTTTCCTTGTTCGCACCGGACACCTCCAGTGACCAGACGGCAAGGTTTTTATCC

CAGTGTATATTGGAAAAACATGTTATACTTTTGACAATTTAACGTGCCTAGAGCTCA

AATTAAACTAATACCATAACGTAATGCAACTTACAACATAAATAAAGGTCAATGTTT

AATCCATAAAAAAAAAAAAAAAAAAA

Non-Limiting Example 4—PEgRNA Expression Platform Consisting of pCMV, Csy4 Hairing, the PEgRNA, and 3' Box (SEQ ID NO: 504)
```
TAGTTATTAATAGTAATCAATTACGGGGTCATTAGTTCATAGCCCATATATGGAGTTC

CGCGTTACATAACTTACGGTAAATGGCCCGCCTGGCTGACCGCCCAACGACCCCC

GCCCATTGACGTCAATAATGACGTATGTTCCCATAGTAACGCCAATAGGGACTTTCC

ATTGACGTCAATGGGTGGAGTATTTACGGTAAACTGCCCACTTGGCAGTACATCAA

GTGTATCATATGCCAAGTACGCCCCCTATTGACGTCAATGACGGTAAATGGCCCGC

CTGGCATTATGCCCAGTACATGACCTTATGGGACTTTCCTACTTGGCAGTACATCTA

CGTATTAGTCATCGCTATTACCATGGTGATGCGGTTTTGGCAGTACATCAATGGGCG

TGGATAGCGGTTTGACTCACGGGGATTTCCAAGTCTCCACCCCATTGACGTCAATG

GGAGTTTGTTTTGGCACCAAAATCAACGGGACTTTCCAAAATGTCGTAACAACTC

CGCCCCATTGACGCAAATGGGCGGTAGGCGTGTACGGTGGGAGGTCTATATAAGC

AGAGCTGGTTTAGTGAACCGTCAGATCGTTCACTGCCGTATAGGCAGGGCCCAGA

CTGAGCACGTGAGTTTTAGAGCTAGAAATAGCAAGTTAAAATAAGGCTAGTCCGT

TATCAACTTGAAAAAGTGGGACCGAGTCGGTCCTCTGCCATCAAAGCGTGCTCAG

TCTGTTTGTTTCAAAAGTAGACTGTACGCTAAGGGTCATATCTTTTTTGTTTGGTT

TGTGTCTTGGTTGGCGTCTTAAA
```

Non-Limiting Example 5—PEgRNA Expression Platform Consisting of pU1, Csy4 Hairping, the PEgRNA, and 3' Box (SEQ ID NO: 505)
```
CTAAGGACCAGCTTCTTTGGGAGAGAACAGACGCAGGGGCGGGAGGGAAAAAG

GGAGAGGCAGACGTCACTTCCCCTTGGCGGCTCTGGCAGCAGATTGGTCGGTTGA

GTGGCAGAAAGGCAGACGGGGACTGGGCAAGGCACTGTCGGTGACATCACGGAC

AGGGCGACTTCTATGTAGATGAGGCAGCGCAGAGGCTGCTGCTTCGCCACTTGCT

GCTTCACCACGAAGGAGTTCCCGTGCCCTGGGAGCGGGTTCAGGACCGCTGATCG

GAAGTGAGAATCCCAGCTGTGTGTCAGGGCTGGAAAGGGCTCGGGAGTGCGCGG

GGCAAGTGACCGTGTGTGTAAAGAGTGAGGCGTATGAGGCTGTGTCGGGGCAGA

GGCCCAAGATCTCAGTTCACTGCCGTATAGGCAGGGCCCAGACTGAGCACGTGAG

TTTTAGAGCTAGAAATAGCAAGTTAAAATAAGGCTAGTCCGTTATCAACTTGAAAA

AGTGGGACCGAGTCGGTCCTCTGCCATCAAAGCGTGCTCAGTCTGTTTCAGCAAG

TTCAGAGAAATCTGAACTTGCTGGATTTTTGGAGCAGGGAGATGGAATAGGAGCT

TGCTCCGTCCACTCCACGCATCGACCTGGTATTGCAGTACCTCCAGGAACGGTGC

ACCCACTTTCTGGAGTTTCAAAAGTAGACTGTACGCTAAGGGTCATATCTTTTTTT

GTTTGGTTTGTGTCTTGGTTGGCGTCTTAAA
```

In various other embodiments, the PEgRNA may be improved by introducing improvements to the scaffold or core sequences. This can be done by introducing known The core, Cas9-binding PEgRNA scaffold can likely be improved to enhance PE activity. Several such approaches have already been demonstrated. For instance, the first pairing element of the scaffold (P1) contains a GTTTT-AAAAC (SEQ ID NO: 3939) pairing element. Such runs of Ts have been shown to result in pol III pausing and premature termination of the RNA transcript. Rational mutation of one of the T-A pairs to a G-C pair in this portion of P1 has been shown to enhance sgRNA activity, suggesting this approach would also be feasible for PEgRNAs[195]. Additionally, increasing the length of P1 has also been shown to enhance sgRNA folding and lead to improved activity[195], suggesting it as another avenue for the improvement of PEgRNA activity. Example improvements to the core can include:

PEgRNA Containing a 6 nt Extension to P1

(SEQ ID NO: 228)
GGCCCAGACTGAGCACGTGAGTTTTAGAGCTAGCTCATGAAAATGAGCTA

GCAAGTTAAAATAAGGCTAGTCCGTTATCAACTTGAAAAAGTGGGACCGA

GTCGGTCCTCTGCCATCAAAGCGTGCTCAGTCTGTTTTTTT

PEgRNA Containing a T-A to G-C Mutation within P1

(SEQ ID NO: 229)
GGCCCAGACTGAGCACGTGAGTTTGAGAGCTAGAAATAGCAAGTTTAAAT

AAGGCTAGTCCGTTATCAACTTGAAAAAGTGGGACCGAGTCGGTCCTCTG

CCATCAAAGCGTGCTCAGTCTGTTTTTTT

In various other embodiments, the PEgRNA may be improved by introducing modifications to the edit template region. As the size of the insertion templated by the PEgRNA increases, it is more likely to be degraded by endonucleases, undergo spontaneous hydrolysis, or fold into secondary structures unable to be reverse-transcribed by the RT or that disrupt folding of the PEgRNA scaffold and subsequent Cas9-RT binding. Accordingly, it is likely that modification to the template of the PEgRNA might be necessary to affect large insertions, such as the insertion of whole genes. Some strategies to do so include the incorporation of modified nucleotides within a synthetic or semi-synthetic PEgRNA that render the RNA more resistant to degradation or hydrolysis or less likely to adopt inhibitory secondary structures[196]. Such modifications could include 8-aza-7-deazaguanosine, which would reduce RNA secondary structure in G-rich sequences; locked-nucleic acids (LNA) that reduce degradation and enhance certain kinds of RNA secondary structure; 2'-O-methyl, 2'-fluoro, or 2'-O-methoxyethoxy modifications that enhance RNA stability. Such modifications could also be included elsewhere in the PEgRNA to enhance stability and activity. Alternatively or additionally, the template of the PEgRNA could be designed such that it both encodes for a desired protein product and is also more likely to adopt simple secondary structures that are able to be unfolded by the RT. Such simple structures would act as a thermodynamic sink, making it less likely that more complicated structures that would prevent reverse transcription would occur. Finally, one could also split the template into two, separate PEgRNAs. In such a design, a PE would be used to initiate transcription and also recruit a separate template RNA to the targeted site via an RNA-binding protein fused to Cas9 or an RNA recognition element on the PEgRNA itself such as the MS2 aptamer. The RT could either directly bind to this separate template RNA, or initiate reverse transcription on the original PEgRNA before swapping to the second template. Such an approach could enable long insertions by both preventing misfolding of the PEgRNA upon addition of the long template and also by not requiring dissociation of Cas9 from the genome for long insertions to occur, which could possibly be inhibiting PE-based long insertions.

In still other embodiments, the PEgRNA may be improved by introducing additional RNA motifs at the 5' and 3' termini of the PEgRNAs. Several such motifs—such as the PAN ENE from KSHV and the ENE from MALAT1 were discussed above as possible means to terminate expression of longer PEgRNAs from non-pol III promoters. These elements form RNA triple helices that engulf the polyA tail, resulting in their being retained within the nucleus[184,187]. However, by forming complex structures at the 3' terminus of the PEgRNA that occlude the terminal nucleotide, these structures would also likely help prevent exonuclease-mediated degradation of PEgRNAs.

Other structural elements inserted at the 3' terminus could also enhance RNA stability, albeit without enabling termination from non-pol III promoters. Such motifs could include hairpins or RNA quadruplexes that would occlude the 3' terminus[197], or self-cleaving ribozymes such as HDV that would result in the formation of a 2'-3'-cyclic phosphate at the 3' terminus and also potentially render the PEgRNA less likely to be degraded by exonucleases[198]. Inducing the PEgRNA to cyclize via incomplete splicing—to form a ciRNA—could also increase PEgRNA stability and result in the PEgRNA being retained within the nucleus[194].

Additional RNA motifs could also improve RT processivity or enhance PEgRNA activity by enhancing RT binding to the DNA-RNA duplex. Addition of the native sequence bound by the RT in its cognate retroviral genome could enhance RT activity[199]. This could include the native primer binding site (PBS), polypurine tract (PPT), or kissing loops involved in retroviral genome dimerization and initiation of transcription[199].

Addition of dimerization motifs—such as kissing loops or a GNRA tetraloop/tetraloop receptor pair[200]—at the 5' and 3' termini of the PEgRNA could also result in effective circularization of the PEgRNA, improving stability. Additionally, it is envisioned that addition of these motifs could enable the physical separation of the PEgRNA spacer and primer, prevention occlusion of the spacer which would hinder PE activity. Short 5' or 3' extensions to the PEgRNA that form a small toehold hairpin in the spacer region could also compete favorably against the annealing region of the PEgRNA binding the spacer. Finally, kissing loops could also be used to recruit other template RNAs to the genomic site and enable swapping of RT activity from one RNA to the other. Example improvements include, but are not limited to:

PEgRNA-HDV Fusion (SEQ ID NO: 230)
GGCCCAGACTGAGCACGTGAGTTTTAGAGCTAGAAATAGCAAGTTAAAAT

AAGGCTAGTCCGTTATCAACTTGAAAAAGTGGGACCGAGTCGGTCCTCTG

CCATCAAAGCGTGCTCAGTCTGGGCCGGCATGGTCCCAGCCTCCTCGCTG

GCGCCGGCTGGGCAACATGCTTCGGCATGGCGAATGGGACTTTTTTT

PEgRNA-MMLV Kissing Loop (SEQ ID NO: 231)
GGTGGGAGACGTCCCACCGGCCCAGACTGAGCACGTGAGTTTTAGAGCTA

GAAATAGCAAGTTAAAATAAGGCTAGTCCGTTATCAACTTGAAAAAGTGG

GACCGAGTCGGTCCTCTGCCATCAAAGCTTCGACCGTGCTCAGTCTGGTG

GGAGACGTCCCACCTTTTTTT

PEgRNA-VS Ribozyme Kissing Loop (SEQ ID NO: 232)
GAGCAGCATGGCGTCGCTGCTCACGGCCCAGACTGAGCACGTGAGTTTTA -continued

GAGCTAGAAATAGCAAGTTAAAATAAGGCTAGTCCGTTATCAACTTGAAA

AAGTGGGACCGAGTCGGTCCTCTGCCATCAAAGCTTCGACCGTGCTCAGT

CTCCATCAGTTGACACCCTGAGGTTTTTTT

PEgRNA-GNRA Tetraloop/Tetraloop Receptor (SEQ ID NO: 233)
GCAGACCTAAGTGGUGACATATGGTCTGGGCCCAGACTGAGCACGTGAGT

TTTAGAGCTAUACGTAGCAAGTTAAAATAAGGCTAGTCCGTTATCAACTT

UACGAAGTGGGACCGAGTCGGTCCTCTGCCATCAAAGCTTCGACCGTGCT

CAGTCTGCATGCGATTAGAAATAATCGCATGTTTTTT

PEgRNA Template Switching Secondary RNA-HDV Fusion (SEQ ID NO: 234)
TCTGCCATCAAAGCTGCGACCGTGCTCAGTCTGGTGGGAGACGTCCCACC

GGCCGGCATGGTCCCAGCCTCCTCGCTGGCGCCGGCTGGGCAACATGCTT

CGGCATGGCGAATGGGACTTTTTTT

PEgRNA scaffold could be further improved via directed evolution, in an analogous fashion to how SpCas9 and prime editor (PE) have been improved. Directed evolution could enhance PEgRNA recognition by Cas9 or evolved Cas9 variants. Additionally, it is likely that different PEgRNA scaffold sequences would be optimal at different genomic loci, either enhancing PE activity at the site in question, reducing off-target activities, or both. Finally, evolution of PEgRNA scaffolds to which other RNA motifs have been added would almost certainly improve the activity of the fused PEgRNA relative to the unevolved, fusion RNA. For instance, evolution of allosteric ribozymes composed of c-di-GMP-I aptamers and hammerhead ribozymes led to dramatically improved activity[202], suggesting that evolution would improve the activity of hammerhead-PEgRNA fusions as well. In addition, while Cas9 currently does not generally tolerate 5' extension of the sgRNA, directed evolution will likely generate enabling mutations that mitigate this intolerance, allowing additional RNA motifs to be utilized.

The present disclosure contemplates any such ways to further improve the efficacy of the prime editing systems disclosed here.

O. Use of Prime Editing with Expanded Targeting Scope

Prime editing (PE) using *Streptococcus pyogenes* Cas9 (SpCas9) can efficiently install all single base substitutions, insertions, deletions, and combinations thereof at genomic loci where there is a suitably-placed NGG protospacer adjacent motif (PAM) that SpCas9 can efficiently bind. However, in another aspect the methods described herein broaden the targeting capability of PE by expanding the accessible PAMs and, therefore, the targetable genomic loci accessible for efficient PE. Prime editors using RNA-guided DNA binding proteins other than SpCas9 enable an expanded targettable scope of genomic loci by allowing access to different PAMs. In addition, use of RNA-guided DNA binding proteins smaller than SpCas9 also allows for more efficient viral delivery. PE with Cas proteins or other RNA-guided DNA binding proteins beyond SpCas9 will allow for high efficiency therapeutic edits that were either inaccessible or inefficient using SpCas9-based PE.

This is expected to be used in situations where SpCas9-based PE is either inefficient due to non-ideal spacing of an edit to relative to an NGG PAM or the overall size of the SpCas9-based construct is prohibitive for cellular expression and/or delivery. Specific disease-relevant loci such as the Huntingtin gene, which has few and poorly located NGG PAMs for SpCas9 near the target region, can easily be targeted using different Cas proteins in the PE system such as SpCas9-VRQR which recognizes an NGA PAM. Smaller Cas proteins will be used to generate smaller PE constructs that can be packaged into AAV vectors more efficiently, enabling better delivery to target tissues. FIG. 61 shows the reduction to practice of prime editing using *Staphylococcus aureus* CRISPR-Cas as the RNA-guided DNA binding protein. NT is untreated control.

FIGS. 62A-62B provide a demonstration of the importance of the protospacer for efficient installation of a desired edit at a precise location with prime editing. This highlights the importance of alternate PAMs and protospacers as novel features of this technology. "n.d." in FIG. 62A is "not detected."

FIG. 63 shows the reduction to practice of PE using SpCas9(H840A)-VRQR and SpCas9(H840A)-VRER as the RNA-guided DNA binding protein in a prime editor system. The SpCas9(H840A)-VRQR napDNAbp is disclosed herein as SEQ ID NO: 87. The SpCas9(H840A)-VRER napDNAbp is disclosed herein as SEQ ID NO: 88. The SpCas9(H840A)-VRER-MMLV RT fusion protein is disclosed herein as SEQ ID NO: 516, wherein the MMLV RT comprises the D200N, L603W, T330P, T306K, and W313F substitutions relative to the wild type MMLV RT. The SpCas9(H840A)-VRQR-MMLV RT fusion protein is disclosed herein as SEQ ID NO: 515, wherein the MMLV RT comprises the D200N, L603W, T330P, T306K, and W313F substitutions relative to the wild type MMLV RT. Seven different loci in the human genome are targeted: 4 with the SpCas9(H840A)-VRQR-MMLV RT prime editor system and 3 with the SpCas9(H840A)-VRER-MMLV RT system. The amino acid sequences of the tested contructs are as follows:

| SACAS9-M-MLV RT PRIME EDITOR | MKRTADGSEFESPKKKRKVGKRNYILGLDIGITSVGYGIIDYETR DVIDAGVRLFKEANVENNEGRRSKRGARRLKRRRRHRIQRVKK LLFDYNLLTDHSELSGINPYEARVKGLSQKLSEEEFSAALLHLA KRRGVHNVNEVEEDTGNELSTKEQISRNSKALEEKYVAELQLE RLKKDGEVRGSINRFKTSDYVKEAKQLLKVQKAYHQLDQSFID TYIDLLETRRTYYEGPGEGSPFGWKDIKEWYEMLMGHCTYFPE ELRSVKYAYNADLYNALNDLNNLVITRDENEKLEYYEKFQIIEN VFKQKKKPTLKQIAKEILVNEEDIKGYRVTSTGKPEFTNLKVYH DIKDITARKEIIENAELLDQIAKILTIYQSSEDIQEELTNLNSELTQE EIEQISNLKGYTGTHNLSLKAINLILDELWHTNDNQIAIFNRLKL VPKKVDLSQQKEIPTTLVDDFILSPVVKRSFIQSIKVINAIIKKYG LPNDIIIELAREKNSKDAQKMINEMQKRNRQTNERIEEIIRTTGK ENAKYLIEKIKLHDMQEGKCLYSLEAIPLEDLLNNPFNYEVDHII PRSVSFDNSFNNKVLVKQEEASKKGNRTPFQYLSSSDSKISYETF |

-continued

```
                      KKHILNLAKGKGRISKTKKEYLLEERDINRFSVQKDFINRNLVD
                      TRYATRGLMNLLRSYFRVNNLDVKVKSINGGFTSFLRRKWKFK
                      KERNKGYKHHAEDALIIANADFIFKEWKKLDKAKKVMENQMF
                      EEKQAESMPEIETEQEYKEIFITPHQIKHIKDFKDYKYSHRVDKK
                      PNRELINDTLYSTRKDDKGNTLIVNNLNGLYDKDNDKLKKLIN
                      KSPEKLLMYHHDPQTYQKLKLIMEQYGDEKNPLYKYYEETGN
                      YLTKYSKKDNGPVIKKIKYYGNKLNAHLDITDDYPNSRNKVVK
                      LSLKPYRFDVYLDNGVYKFVTVKNLDVIKKENYYEVNSKCYE
                      EAKKLKKISNQAEFIASFYNNDLIKINGELYRVIGVNNDLLNRIE
                      VNMIDITYREYLENMNDKRPPRIIKTIASKTQSIKKYSTDILGNL
                      YEVKSKKHPQIIKKGSGGSSGGSSGSETPGTSESATPESSGGSSG
                      GSSTLNIEDEYRLHETSKEPDVSLGSTWLSDFPQAWAETGGMGL
                      AVRQAPLIIPLKATSTPVSIKQYPMSQEARLGIKPHIQRLLDQGIL
                      VPCQSPWNTPLLPVKKPGTNDYRPVQDLREVNKRVEDIHPTVP
                      NPYNLLSGLPPSHQWYTVLDLKDAFFCLRLHPTSQPLFAFEWR
                      DPEMGISGQLTWTRLPQGFKNSPTLFDEALHRDLADFRIQHPDL
                      ILLQYVDDLLLAATSELDCQQGTRALLQTLGNLGYRASAKKAQ
                      ICQKQVKYLGYLLKEGQRWLTEARKETVMGQPTPKTPRQLREF
                      LGTAGFCRLWIPGFAEMAAPLYPLTKTGTLFNWGPDQQKAYQEI
                      KQALLTAPALGLPDLTKPFELFVDEKQGYAKGVLTQKLGPWRR
                      PVAYLSKKLDPVAAGWPPCLRMVAAIAVLTKDAGKLTMGQPLVI
                      WYTDGSSLLQEGQRKAGAAVTTETEVIWAKALPAGTSAQRAEL
                      LAPHAVEALVKQPPDRWLSNARMTHYQALLLDTDRVQFGPVV
                      ALNPATLLPLPEEGLQHNCLDILAEAHGTRPDLTDQPLPDADHT
                      IALTQALKMAEGKKLNVYTDSRYAFATAHIHGEIYRRRGLLTSE
                      GKEIKNKDEILALLKALFLPKRLSIIHCPGHQKGHSAEARGNRM
                      ADQAARKAAITETPDTSTLLIENSSPSGGSKRTADGSEFEPKKKR
                      KV (SEQ ID NO: 514)

SPC AS 9(H840A)-      MKRTADGSEFESPKKKRKVDKKYSIGLDIGTNSVGWAVITDEY
VRQR- MALONEY         KVPSKKFKVLGNTDRHSIKKNLIGALLFDSGETAEATRLKRTAR
MURINE                RRYTRRKNRICYLQEIFSNEMAKVDDSFFHRLEESFLVEEDKKH
LEUKEMIA VIRUS        ERHPIFGNIVDEVAYHEKYPTIYHLRKKLVDSTDKADLRLIYLAL
REVERSE               AHMIKFRGHFLIEGDLNPDNSDVDKLFIQLVQTYNQLFEENPIN
TRANSCRIPTASE         ASGVDAKAILSARLSKSRRLENLIAQLPGEKKNGLFGNLIALSL
PRIME EDITOR          GLTPNFKSNFDLAEDAKLQLSKDTYDDDLDNLLAQIGDQYADL
                      FLAAKNLSDAILLSDILRVNTEITKAPLSASMIKRYDEHHQDLTL
                      LKALVRQQLPEKYKEIFFDQSKNGYAGYIDGGASQEEFYKFIKPI
                      LEKMDGTEELLVKLNREDLLRKQRTFDNGSIPHQIHLGELHAIL
                      RRQEDFYPFLKDNREKIEKILTFRIPYYVGPLARGNSRFAWMTR
                      KSEETITPWNFEEVVDKGASAQSFIERMTNFDKNLPNEKVLPKH
                      SLLYEYFTVYNELTKVKYVTEGMRKPAFLSGEQKKAIVDLLFKT
                      NRKVTVKQLKEDYFKKIECFDSVEISGVEDRFNASLGTYHDLL
                      KIIKDKDFLDNEENEDILEDIVLTLTLFEDREMIEERLKTYAHLFD
                      DKVMKQLKRRRYTGWGRLSRKLINGIRDKQSGKTILDFLKSDG
                      FANRNFMQLIHDDSLTFKEDIQKAQVSGQGDSLHEHIANLAGSP
                      AIKKGILQTVKVVDELVKVMGRHKPENIVIEMARENQTTQKGQ
                      KNSRERMKRIEEGIKELGSQILKEHPVENTQLQNEKLYLYYLQN
                      GRDMYVDQELDINRLSDYDVDAIVPQSFLKDDSIDNKVLTRSD
                      KNRGKSDNVPSEEVVKKMKNYWRQLLNAKLITQRKFDNLTKA
                      ERGGLSELDKAGFIKRQLVETRQITKHVAQILDSRMNTKYDEND
                      KLIREVKVITLKSKLVSDFRKDFQFYKVREINNYHHAHDAYLNA
                      VVGTALIKKYPKLESEFVYGDYKVYDVRKMIAKSEQEIGKATA
                      KYFFYSNIMNFFKTEITLANGEIRKRPLIETNGETGEIVWDKGRD
                      FATVRKVLSMPQVNIVKKTEVQTGGFSKESILPKRNSDKLIARK
                      KDWDPKKYGGFVSPTVAYSVLVVAKVEKGKSKKLKSVKELLGI
                      TINIERSSFEKNPIDFLEAKGYKEVKKDLIIKLPKYSLFELENGRK
                      RMLASARELQKGNELALPSKYVNFLYLASHYEKLKGSPEDNEQ
                      KQLFVEQHKHYLDEIIEQISEFSKRVILADANLDKVLSAYNKHR
                      DKPIREQAENIIHLFTLTNLGAPAAFKYFDTTIDRKQYRSTKEVL
                      DATLIHQSITGLYETRIDLSQLGGDSGGSSGGSSGSETPGTSESAT
                      PESSGGSSGGSSTLNIEDEYRLHETSKEPDVSLGSTWLSDFPQA
                      WAETGGMGLAVRQAPLIIPLKATSTPVSIKQYPMSQEARLGIKP
                      HIQRLLDQGILVPCQSPWNTPLLPVKKPGTNDYRPVQDLREVN
                      KRVEDIHPTVPNPYNLLSGLPPSHQWYTVLDLKDAFFCLRLHPT
                      SQPLFAFEWRDPEMGISGQLTWTRLPQGFKNSPTLFNEALHRDL
                      ADFRIQHPDLILLQYVDDLLLAATSELDCQQGTRALLQTLGNLG
                      YRASAKKAQICQKQVKYLGYLLKEGQRWLTEARKETVMGQPT
                      PKTPRQLREFLGKAGFCRLFIPGFAEMAAPLYPLTKPGTLFNWG
                      PDQQKAYQEIKQALLTAPALGLPDLTKPFELFVDEKQGYAKGVL
                      TQKLGPWRRPVAYLSKKLDPVAAGWPPCLRMVAAIAVLTKDAG
                      KLTMGQPLVILAPHAVEALVKQPPDRWLSNARMTHYQALLLDT
                      DRVQFGPVVALNPATLLPLPEEGLQHNCLDILAEAHGTRPDLTD
                      QPLPDADHTWYTDGSSLLQEGQRKAGAAVTTETEVIWAKALPA
                      GTSAQRAELIALTQALKMAEGKKLNVYTDSRYAFATAHIHGEIY
                      RRRGWLTSEGKEIKNKDEILALLKALFLPKRLSIIHCPGHQKGHS
                      AEARGNRMADQAARKAAITETPDTSTLLIENSSPSGGSKRTADG
                      SEFEPKKKRKV (SEQ ID NO: 515)
```

```
SPC AS 9(H840A)-   MKRTADGSEFESPKKKRKVDKKYSIGLDIGTNSVGWAVITDEY
VRER-MALONEY       KVPSKKFKVLGNTDRHSIKKNLIGALLFDSGETAEATRLKRTAR
MURINE             RRYTRRKNRICYLQEIFSNEMAKVDDSFFHRLEESFLVEEDKKH
LEUKEMIA VIRUS     ERHPIFGNIVDEVAYHEKYPTIYHLRKKLVDSTDKADLRLIYLAL
REVERSE            AHMIKFRGHFLIEGDLNPDNSDVDKLFIQLVQTYNQLFEENPIN
TRANSCRIPTASE      ASGVDAKAILSARLSKSRRLENLIAQLPGEKKNGLFGNLIALSL
PRIME EDITOR       GLTPNFKSNFDLAEDAKLQLSKDTYDDDLDNLLAQIGDQYADL
                   FLAAKNLSDAILLSDILRVNTEITKAPLSASMIKRYDEHHQDLTL
                   LKALVRQQLPEKYKEIFFDQSKNGYAGYIDGGASQEEFYKFIKPI
                   LEKMDGTEELLVKLNREDLLRKQRTFDNGSIPHQIHLGELHAIL
                   RRQEDFYPFLKDNREKIEKILTFRIPYYVGPLARGNSRFAWMTR
                   KSEETITPWNFEEVVDKGASAQSFIERMTNFDKNLPNEKVLPKH
                   SLLYEYFTVYNELTKVKYVTEGMRKPAFLSGEQKKAIVDLLFKT
                   NRKVTVKQLKEDYFKKIECFDSVEISGVEDRFNASLGTYHDLL
                   KIIKDKDFLDNEENEDILEDIVLTLTLFEDREMIEERLKTYAHLFD
                   DKVMKQLKRRRYTGWGRLSRKLINGIRDKQSGKTILDFLKSDG
                   FANRNFMQLIHDDSLTFKEDIQKAQVSGQGDSLHEHIANLAGSP
                   AIKKGILQTVKVVDELVKVMGRHKPENIVIEMARENQTTQKGQ
                   KNSRERMKRIEEGIKELGSQILKEHPVENTQLQNEKLYLYYLQN
                   GRDMYVDQELDINRLSDYDVDAIVPQSFLKDDSIDNKVLTRSD
                   KNRGKSDNVPSEEVVKKMKNYWRQLLNAKLITQRKFDNLTKA
                   ERGGLSELDKAGFIKRQLVETRQITKHVAQILDSRMNTKYDEND
                   KLIREVKVITLKSKLVSDFRKDFQFYKVREINNYHHAHDAYLNA
                   VVGTALIKKYPKLESEFVYGDYKVYDVRKMIAKSEQEIGKATA
                   KYFFYSNIMNFFKTEITLANGEIRKRPLIETNGETGEIVWDKGRD
                   FATVRKVLSMPQVNIVKKTEVQTGGFSKESILPKRNSDKLIARK
                   KDWDPKKYGGFVSPTVAYSVLVVAKVEKGKSKKLKSVKELLGI
                   TIMERSSFEKNPIDFLEAKGYKEVKKDLIIKLPKYSLFELENGRK
                   RMLASARELQKGNELALPSKYVNFLYLASHYEKLKGSPEDNEQ
                   KQLFVEQHKHYLDEIIEQISEFSKRVILADANLDKVLSAYNKHR
                   DKPIREQAENIIHLFTLTNLGAPAAFKYFDTTIDRKEYRSTKEVL
                   DATLIHQSITGLYETRIDLSQLGGDSGGSSGGSSGSETPGTSESAT
                   PESSGGSSGGSSTLNIEDEYRLHETSKEPDVSLGSTWLSDFPQA
                   WAETGGMGLAVRQAPLIIPLKATSTPVSIKQYPMSQEARLGIKP
                   HIQRLLDQGILVPCQSPWNTPLLPVKKPGTNDYRPVQDLREVN
                   KRVEDIHPTVPNPYNLLSGLPPSHQWYTVLDLKDAFFCLRLHPT
                   SQPLFAFEWRDPEMGISGQLTWTRLPQGFKNSPTLFNEALHRDL
                   ADFRIQHPDLILLQYVDDLLLAATSELDCQQGTRALLQTLGNLG
                   YRASAKKAQICQKQVKYLGYLLKEGQRWLTEARKETVMGQPT
                   PKTPRQLREFLGKAGFCRLFIPGFAEMAAPLYPLTKPGTLFNWG
                   PDQQKAYQEIKQALLTAPALGLPDLTKPFELFVDEKQGYAKGVL
                   TQKLGPWRRPVAYLSKKLDPVAAGWPPCLRMVAAIAVLTKDAG
                   KLTMGQPLVILAPHAVEALVKQPPDRWLSNARMTHYQALLLDT
                   DRVQFGPVVALNPATLLPLPEEGLQHNCLDILAEAHGTRPDLTD
                   QPLPDADHTWYTDGSSLLQEGQRKAGAAVTTETEVIWAKALPA
                   GTSAQRAELIALTQALKMAEGKKLNVYTDSRYAFATAHIHGEIY
                   RRRGWLTSEGKEIKNKDEILALLKALFLPKRLSIIHCPGHQKGHS
                   AEARGNRMADQAARKAAITETPDTSTLLIENSSPSGGSKRTADG
                   SEFEPKKKRKV (SEQ ID NO: 516)
```

As shown in FIG. 63, the SpCas9(H840A)-VRQR-MMLV RT was operational at PAM sites that included "AGAG" and "GGAG", with some editing activity at "GGAT" and "AGAT" PAM sequences. The SpCas9 (H840A)-VRER-MMLV RT was operational at PAM sites that included "AGCG" and "GGCG", with some editing activity at "TGCG."

The data demonstrates that prime editing may be conducted using napDNAbps which bear different PAM specificities, such as those Cas9 variant described herein.

In various embodiments, the napDNAbp (e.g., Cas9) with altered PAM specificities comprise a combination of mutations that exhibit activity on a target sequence comprising a 5'-NAA-3' PAM sequence at its 3'-end. In some embodiments, the combination of mutations are present in any one of the clones listed in Table 1. In some embodiments, the combination of mutations are conservative mutations of the clones listed in Table 1. In some embodiments, the Cas9 protein comprises the combination of mutations of any one of the Cas9 clones listed in Table 1.

TABLE 1

NAA PAM Clones
Mutations from wild-type SpCas9 (e.g., SEQ ID NO: 18)

D177N, K218R, D614N, D1135N, P1137S, E1219V, A1320V, A1323D, R1333K
D177N, K218R, D614N, D1135N, E1219V, Q1221H, H1264Y, A1320V, R1333K
A10T, I322V, S409I, E427G, G715C, D1135N, E1219V, Q1221H, H1264Y, A1320V, R1333K
A367T, K710E, R1114G, D1135N, P1137S, E1219V, Q1221H, H1264Y, A1320V, R1333K
A10T, I322V, S409I, E427G, R753G, D861N, D1135N, K1188R, E1219V, Q1221H, H1264H, A1320V, R1333K
A10T, I322V, S409I, E427G, R654L, V743I, R753G, M1021T, D1135N, D1180G, K1211R, E1219V, Q1221H, H1264Y, A1320V, R1333K

TABLE 1-continued

NAA PAM Clones
Mutations from wild-type SpCas9 (e.g., SEQ ID NO: 18)

A10T, I322V, S409I, E427G, V743I, R753G, E762G, D1135N, D1180G, K1211R, E1219V,
Q1221H, H1264Y, A1320V, R1333K
A10T, I322V, S409I, E427G, R753G, D1135N, D1180G, K1211R, E1219V, Q1221H,
H1264Y, S1274R, A1320V, R1333K
A10T, I322V, S409I, E427G, A589S, R753G, D1135N, E1219V, Q1221H, H1264H,
A1320V, R1333K
A10T, I322V, S409I, E427G, R753G, E757K, G865G, D1135N, E1219V, Q1221H, H1264Y,
A1320V, R1333K
A10T, I322V, S409I, E427G, R654L, R753G, E757K, D1135N, E1219V, Q1221H, H1264Y,
A1320V, R1333K
A10T, I322V, S409I, E427G, K599R, M631A, R654L, K673E, V743I, R753G, N758H,
E762G, D1135N, D1180G, E1219V, Q1221H, Q1256R, H1264Y, A1320V, A1323D,
R1333K
A10T, I322V, S409I, E427G, R654L, K673E, V743I, R753G, E762G, N869S, N1054D,
R1114G, D1135N, D1180G, E1219V, Q1221H, H1264Y, A1320V, A1323D, R1333K
A10T, I322V, S409I, E427G, R654L, L727I, V743I, R753G, E762G, R859S, N946D,
F1134L, D1135N, D1180G, E1219V, Q1221H, H1264Y, N1317T, A1320V, A1323D,
R1333K
A10T, I322V, S409I, E427G, R654L, K673E, V743I, R753G, E762G, N803S, N869S,
Y1016D, G1077D, R1114G, F1134L, D1135N, D1180G, E1219V, Q1221H, H1264Y,
V1290G, L1318S, A1320V, A1323D, R1333K
A10T, I322V, S409I, E427G, R654L, K673E, V743I, R753G, E762G, N803S, N869S,
Y1016D, G1077D, R1114G, F1134L, D1135N, K1151E, D1180G, E1219V, Q1221H,
H1264Y, V1290G, L1318S, A1320V, R1333K
A10T, I322V, S409I, E427G, R654L, K673E, V743I, R753G, E762G, N803S, N869S,
Y1016D, G1077D, R1114G, F1134L, D1135N, D1180G, E1219V, Q1221H, H1264Y,
V1290G, L1318S, A1320V, A1323D, R1333K
A10T, I322V, S409I, E427G, R654L, K673E, F693L, V743I, R753G, E762G, N803S, N869S,
L921P, Y1016D, G1077D, F1080S, R1114G, D1135N, D1180G, E1219V, Q1221H, H1264Y,
L1318S, A1320V, A1323D, R1333K
A10T, I322V, S409I, E427G, E630K, R654L, K673E, V743I, R753G, E762G, Q768H,
N803S, N869S, Y1016D, G1077D, R1114G, F1134L, D1135N, D1180G, E1219V, Q1221H,
H1264Y, L1318S, A1320V, R1333K
A10T, I322V, S409I, E427G, R654L, K673E, F693L, V743I, R753G, E762G, Q768H,
N803S, N869S, Y1016D, G1077D, R1114G, F1134L, D1135N, D1180G, E1219V, Q1221H,
G1223S, H1264Y, L1318S, A1320V, R1333K
A10T, I322V, S409I, E427G, R654L, K673E, F693L, V743I, R753G, E762G, N803S, N869S,
L921P, Y1016D, G1077D, F1801S, R1114G, D1135N, D1180G, E1219V, Q1221H, H1264Y,
L1318S, A1320V, A1323D, R1333K
A10T, I322V, S409I, E427G, R654L, V743I, R753G, M1021T, D1135N, D1180G, K1211R,
E1219V, Q1221H, H1264Y, A1320V, R1333K
A10T, I322V, S409I, E427G, R654L, K673E, V743I, R753G, E762G, M673I, N803S, N869S,
G1077D, R1114G, D1135N, V1139A, D1180G, E1219V, Q1221H, A1320V, R1333K
A10T, I322V, S409I, E427G, R654L, K673E, V743I, R753G, E762G, N803S, N869S,
R1114G, D1135N, E1219V, Q1221H, A1320V, R1333K

In some embodiments, the Cas9 protein comprises an amino acid sequence that is at least 80% identical to the amino acid sequence of a Cas9 protein as provided by any one of the variants of Table 1. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 1.

In some embodiments, the Cas9 protein exhibits an increased activity on a target sequence that does not comprise the canonical PAM (5'-NGG-3') at its 3' end as compared to Streptococcus pyogenes Cas9 as provided by SEQ ID NO: 18. In some embodiments, the Cas9 protein exhibits an activity on a target sequence having a 3' end that is not directly adjacent to the canonical PAM sequence (5'-NGG-3') that is at least 5-fold increased as compared to the activity of Streptococcus pyogenes Cas9 as provided by SEQ ID NO: 18 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of Streptococcus pyogenes as provided by SEQ ID NO: 18 on the same target sequence. In some embodiments, the 3' end of the target sequence is directly adjacent to an AAA, GAA, CAA, or TAA sequence. In some embodiments, the Cas9 protein comprises a combination of mutations that exhibit activity on a target sequence comprising a 5'-NAC-3' PAM sequence at its 3'-end. In some embodiments, the combination of mutations are present in any one of the clones listed in Table 2. In some embodiments, the combination of mutations are conservative mutations of the clones listed in Table 2. In some embodiments, the Cas9 protein comprises the combination of mutations of any one of the Cas9 clones listed in Table 2.

TABLE 2

NAC PAM Clones
MUTATIONS FROM WILD-TYPE SPCAS9 (E.G., SEQ ID NO: 18)

T472I, R753G, K890E, D1332N, R1335Q, T1337N
I1057S, D1135N, P1301S, R1335Q, T1337N
T472I, R753G, D1332N, R1335Q, T1337N
D1135N, E1219V, D1332N, R1335Q, T1337N
T472I, R753G, K890E, D1332N, R1335Q, T1337N
I1057S, D1135N, P1301S, R1335Q, T1337N
T472I, R753G, D1332N, R1335Q, T1337N
T472I, R753G, Q771H, D1332N, R1335Q, T1337N
E627K, T638P, K652T, R753G, N803S, K959N, R1114G, D1135N, E1219V, D1332N, R1335Q, T1337N
E627K, T638P, K652T, R753G, N803S, K959N, R1114G, D1135N, K1156E, E1219V, D1332N, R1335Q, T1337N
E627K, T638P, V647I, R753G, N803S, K959N, G1030R, I1055E, R1114G, D1135N, E1219V, D1332N, R1335Q, T1337N
E627K, E630G, T638P, V647A, G687R, N767D, N803S, K959N, R1114G, D1135N, E1219V, D1332G, R1335Q, T1337N
E627K, T638P, R753G, N803S, K959N, R1114G, D1135N, E1219V, N1266H, D1332N, R1335Q, T1337N
E627K, T638P, R753G, N803S, K959N, I1057T, R1114G, D1135N, E1219V, D1332N, R1335Q, T1337N
E627K, T638P, R753G, N803S, K959N, R1114G, D1135N, E1219V, D1332N, R1335Q, T1337N
E627K, M631I, T638P, R753G, N803S, K959N, Y1036H, R1114G, D1135N, E1219V, D1251G, D1332G, R1335Q, T1337N
E627K, T638P, R753G, N803S, V875I, K959N, Y1016C, R1114G, D1135N, E1219V, D1251G, D1332G, R1335Q, T1337N, I1348V
K608R, E627K, T638P, V647I, R654L, R753G, N803S, T804A, K848N, V922A, K959N, R1114G, D1135N, E1219V, D1332N, R1335Q, T1337N
K608R, E627K, T638P, V647I, R753G, N803S, V922A, K959N, K1014N, V1015A, R1114G, D1135N, K1156N, E1219V, N1252D, D1332N, R1335Q, T1337N
K608R, E627K, R629G, T638P, V647I, A711T, R753G, K775R, K789E, N803S, K959N, V1015A, Y1036H, R1114G, D1135N, E1219V, N1286H, D1332N, R1335Q, T1337N
K608R, E627K, T638P, V647I, T740A, R753G, N803S, K948E, K959N, Y1016S, R1114G, D1135N, E1219V, N1286H, D1332N, R1335Q, T1337N
K608R, E627K, T638P, V647I, T740A, N803S, K948E, K959N, Y1016S, R1114G, D1135N, E1219V, N1286H, D1332N, R1335Q, T1337N
I670S, K608R, E627K, E630G, T638P, V647I, R653K, R753G, I795L, K797N, N803S, K866R, K890N, K959N, Y1016C, R1114G, D1135N, E1219V, D1332N, R1335Q, T1337N
K608R, E627K, T638P, V647I, T740A, G752R, R753G, K797N, N803S, K948E, K959N, V1015A, Y1016S, R1114G, D1135N, E1219V, N1266H, D1332N, R1335Q, T1337N
I570T, A589V, K608R, E627K, T638P, V647I, R654L, Q716R, R753G, N803S, K948E, K959N, Y1016S, R1114G, D1135N, E1207G, E1219V, N1234D, D1332N, R1335Q, T1337N
K608R, E627K, R629G, T638P, V647I, R654L, Q740R, R753G, N803S, K959N, N990S, T995S, V1015A, Y1036D, R1114G, D1135N, E1207G, E1219V, N1234D, N1266H, D1332N, R1335Q, T1337N
I562F, V565D, I570T, K608R, L625S, E627K, T638P, V647I, R654I, G752R, R753G, N803S, N808D, K959N, M1021L, R1114G, D1135N, N1177S, N1234D, D1332N, R1335Q, T1337N
I562F, I570T, K608R, E627K, T638P, V647I, R753G, E790A, N803S, K959N, V1015A, Y1036H, R1114G, D1135N, D1180E, A1184T, E1219V, D1332N, R1335Q, T1337N
I570T, K608R, E627K, T638P, V647I, R654H, R753G, E790A, N803S, K959N, V1015A, R1114G, D1127A, D1135N, E1219V, D1332N, R1335Q, T1337N
I570T, K608R, L625S, E627K, T638P, V647I, R654I, T703P, R753G, N803S, N808D, K959N, M1021L, R1114G, D1135N, E1219V, D1332N, R1335Q, T1337N
I570S, K608R, E627K, E630G, T638P, V647I, R653K, R753G, I795L, N803S, K866R, K890N, K959N, Y1016C, R1114G, D1135N, E1219V, D1332N, R1335Q, T1337N
I570T, K608R, E627K, T638P, V647I, R654H, R753G, E790A, N803S, K959N, V1016A, R1114G, D1135N, E1219V, K1246E, D1332N, R1335Q, T1337N
K608R, E627K, T638P, V647I, R654L, K673E, R753G, E790A, N803S, K948E, K959N, R1114G, D1127G, D1135N, D1180E, E1219V, N1286H, D1332N, R1335Q, T1337N
K608R, L625S, E627K, T638P, V647I, R654I, I670T, R753G, N803S, N808D, K959N, M1021L, R1114G, D1135N, E1219V, N1286H, D1332N, R1335Q, T1337N
E627K, M631V, T638P, V647I, K710E, R753G, N803S, N808D, K948E, M1021L, R1114G, D1135N, E1219V, D1332N, R1335Q, T1337N, S1338T, H1349R

In some embodiments, the Cas9 protein comprises an amino acid sequence that is at least 80% identical to the amino acid sequence of a Cas9 protein as provided by any one of the variants of Table 2. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 2.

In some embodiments, the Cas9 protein exhibits an increased activity on a target sequence that does not comprise the canonical PAM (5'-NGG-3') at its 3' end as compared to *Streptococcus pyogenes* Cas9 as provided by SEQ ID NO: 18. In some embodiments, the Cas9 protein exhibits an activity on a target sequence having a 3' end that is not directly adjacent to the canonical PAM sequence (5'-NGG-3') that is at least 5-fold increased as compared to the activity of *Streptococcus pyogenes* Cas9 as provided by SEQ ID NO: 18 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* as provided by SEQ ID NO: 18 on the same target sequence. In some embodiments, the 3' end of the target sequence is directly adjacent to an AAC, GAC, CAC, or TAC sequence.

In some embodiments, the Cas9 protein comprises a combination of mutations that exhibit activity on a target sequence comprising a 5'-NAT-3' PAM sequence at its 3'-end. In some embodiments, the combination of mutations are present in any one of the clones listed in Table 3. In some embodiments, the combination of mutations are conservative mutations of the clones listed in Table 3. In some embodiments, the Cas9 protein comprises the combination of mutations of any one of the Cas9 clones listed in Table 3.

that site to effecuate a variety of recombination outcomes, such as, excision, integration, inversion, or exchange of DNA fragments. For example, FIG. 65 illustrates the installation of a recombinase site that can then be used to integrate a DNA donor template comprising a GFP expression marker. Cells containing the integrated GFP expression system into the recombinase site will fluoresce.

The mechanism of installing a recombinase site into the genome is analogous to installing other sequences, such as peptide/protein and RNA tags, into the genome. A schematic exemplifying the installation of a recombinase target sequence is shows in FIG. 64(a). The process begins with selecting a desired target locus into which the recombinase target sequence will be introduced. Next, a prime editor fusion is provided ("RT-Cas9:gRNA"). Here, the "gRNA" refers to a PEgRNA, which can be designed using the principles described herein. The PEgRNA in various embodiments will comprise an architecture corresponding to FIG. 3D (5'-[~20-nt spacer]-[gRNA core]-[extension arm]-3', wherein the extension arm comprises in the 3' to 5'

TABLE 3

NAT PAM Clones
MUTATIONS FROM WILD-TYPE SPCAS9 (E.G., SEQ ID NO: 18)

K961E, H985Y, D1135N, K1191N, E1219V, Q1221H, A1320A, P1321S, R1335L
D1135N, G1218S, E1219V, Q1221H, P1249S, P1321S, D1322G, R1335L
V743I, R753G, E790A, D1135N, G1218S, E1219V, Q1221H, A1227V, P1249S, N1286K,
A1293T, P1321S, D1322G, R1335L, T1339I
F575S, M631L, R654L, V748I, V743I, R753G, D853E, V922A, R1114G D1135N, G1218S,
E1219V, Q1221H, A1227V, P1249S, N1286K, A1293T, P1321S, D1322G, R1335L, T1339I
F575S, M631L, R654L, R664K, R753G, D853E, V922A, R1114G D1135N, D1180G, G1218S,
E1219V, Q1221H, P1249S, N1286K, P1321S, D1322G, R1335L
M631L, R654L, R753G, K797E, D853E, V922A, D1012A, R1114G D1135N, G1218S,
E1219V, Q1221H, P1249S, N1317K, P1321S, D1322G, R1335L
F575S, M631L, R654L, R664K, R753G, D853E, V922A, R1114G, Y1131C, D1135N,
D1180G, G1218S, E1219V, Q1221H, P1249S, P1321S, D1322G, R1335L
F575S, M631L, R654L, R664K, R753G, D853E, V922A, R1114G, Y1131C, D1135N,
D1180G, G1218S, E1219V, Q1221H, P1249S, P1321S, D1322G, R1335L
F575S, D596Y, M631L, R654L, R664K, R753G, D853E, V922A, R1114G, Y1131C, D1135N,
D1180G, G1218S, E1219V, Q1221H, P1249S, Q1256R, P1321S, D1322G, R1335L
F575S, M631L, R654L, R664K, K710E, V750A, R753G, D853E, V922A, R1114G, Y1131C,
D1135N, D1180G, G1218S, E1219V, Q1221H, P1249S, P1321S, D1322G, R1335L
F575S, M631L, K649R, R654L, R664K, R753G, D853E, V922A, R1114G, Y1131C, D1135N,
K1156E, D1180G, G1218S, E1219V, Q1221H, P1249S, P1321S, D1322G, R1335L
F575S, M631L, R654L, R664K, R753G, D853E, V922A, R1114G, Y1131C, D1135N,
D1180G, G1218S, E1219V, Q1221H, P1249S, P1321S, D1322G, R1335L
F575S, M631L, R654L, R664K, R753G, D853E, V922A, I1057G, R1114G, Y1131C, D1135N,
D1180G, G1218S, E1219V, Q1221H, P1249S, N1308D, P1321S, D1322G, R1335L
M631L, R654L, R753G, D853E, V922A, R1114G, Y1131C, D1135N, E1150V, D1180G,
G1218S, E1219V, Q1221H, P1249S, P1321S, D1332G, R1335L
M631L, R654L, R664K, R753G, D853E, I1057V, Y1131C, D1135N, D1180G, G1218S,
E1219V, Q1221H, P1249S, P1321S, D1332G, R1335L
M631L, R654L, R664K, R753G, I1057V, R1114G, Y1131C, D1135N, D1180G, G1218S,
E1219V, Q1221H, P1249S, P1321S, D1332G, R1335L

Any of the above Cas9 variants displaying differential PAM specificities as compared to the canonical SpCas9 may be used in the herein disclosed prime editors.

P. Use of Prime Editing for Inserting Recombinase Target Sites

In another aspect, prime editing may be used to insert recombinase sites (or "recombinase recognition sequences") into a desired genomic site. Insertion of recombinase sites provides a programmed location for effecting site-specific genetic changes in a genome. Such genetic changes can include, for example, genomic integration of a plasmid, genomic deletion or insertion, chromosomal translocations, and cassette exchanges, among other genetic changes. These exemplary types of genetic changes are illustrated in FIGS. 64B-64F. The installed recombinase recognition sequences may then be used to conduct site-specific recombination at direction, a primer binding site ("A"), an edit template ("B"), and a homology arm ("C"). The edit template ("B") will comprise a sequence corresponding to a recombinase site, i.e., a single strand RNA of the PEgRNA that codes for a complementary single strand DNA that is either the sense or the antisense strand of the recombinase site and which is incorporated into the genomic DNA target locus through the prime editing process.

In various aspects, the present disclosure provides for the use of a PE to introduce recombinase recognition sequences at high-value loci in human or other genomes, which, after exposure to site-specific recombinase(s), will direct precise and efficient genomic modifications (FIG. 64). In various embodiments show in FIG. 64, PE may be used to (b) insert a single SSR target for use as a site for genomic integration of a DNA donor template. (c) shows how a tandem insertion of SSR target sites can be used to delete a portion of the genome. (d) shows how a tandem insertion of SSR target sites can be used to invert a portion of the genome. (e) shows how the insertion of two SSR target sites at two distal chromosomal regions can result in chromosomal translocation. (f) shows how the insertion of two different SSR target sites in the genome can be used to exchange a cassette from a DNA donor template. Each of the types of genome modifications are envisioned by using PE to insert SSR targets, but this list also is not meant to be limiting.

PE-mediated introduction of recombinase recognition sequences could be particularly useful for the treatment of genetic diseases which are caused by large-scale genomic defects, such as gene loss, inversion, or duplication, or chromosomal translocation[1-7] (Table 6). For example, Williams-Beuren syndrome is a developmental disorder caused by a deletion of 24 in chromosome 721. No technology exists currently for the efficient and targeted insertion of multiple entire genes in living cells (the potential of PE to do such a full-length gene insertion is currently being explored but has not yet been established); however, recombinase-mediated integration at a target inserted by PE offers one approach towards a permanent cure for this and other diseases. In addition, targeted introduction of recombinase recognition sequences could be highly enabling for applications including generation of transgenic plants, animal research models, bioproduction cell lines, or other custom eukaryotic cell lines. For example, recombinase-mediated genomic rearrangement in transgenic plants at PE-specific targets could overcome one of the bottlenecks to generating agricultural crops with improved properties[8,9].

TABLE 6

Examples of genetic diseases linked to large-scale genomic modifications that could be repaired through PE-based installation of recombinase recognition sequences.

| DISEASE | CAUSE |
| --- | --- |
| TRISOMY 17P | GENE DUPLICATION |
| CHARCOT-MARIE-TOOTH DISEASE TYPE I | GENE DUPLICATION |
| SMITH-MAGENIS SYNDROME | GENE DELETION |
| WILLIAMS-BEUREN SYNDROME | GENE DELETION |
| DE LA CHAPELLE SYNDROME | CHROMOSOMAL TRANSLOCATION |
| DOWN SYNDROME (SOME FORMS) | CHROMOSOMAL TRANSLOCATION |
| HEMOPHILIA A | GENE INVERSION |
| HUNTER SYNDROME | GENE INVERSION |

A number of SSR family members have been characterized and their recombinase recognition sequences described, including natural and engineered tyrosine recombinases (Table 7), large serine integrases (Table 8), serine resolvases (Table 9), and tyrosine integrases (Table 10). Modified target sequences that demonstrate enhanced rates of genomic integration have also been described for several SSRs[22-30]. In addition to natural recombinases, programmable recombinases with distinct specificities have been developed[31-40]. Using PE, one or more of these recognition sequences could be introduced into the genome at a specified location, such as a safe harbor locus[41-43], depending on the desired application.

For example, introduction of a single recombinase recognition sequence in the genome by prime editing would result in integrative recombination with a DNA donor template (FIG. 64b). Serine integrases, which operate robustly in human cells, may be especially well-suited for gene integration[44-45].

Additionally, introduction of two recombinase recognition sequences could result in deletion of the intervening sequence, inversion of the intervening sequence, chromosomal translocation, or cassette exchange, depending on the identity and orientation of the targets (FIGS. 64C-64F). By choosing endogenous sequences that already closely resemble recombinase targets, the scope of editing required to introduce the complete recombinase target would be reduced.

Finally, several recombinases have been demonstrated to integrate into human or eukaryotic genomes at natively occurring pseudosites[46-64]. PE editing could be used to modify these loci to enhance rates of integration at these natural pseudosites, or alternatively, to eliminate pseudosites that may serve as unwanted off-target sequences.

This disclosure describes a general methodology for introducing recombinase target sequences in eukaryotic genomes using PE, the applications of which are nearly limitless. The genome editing reactions are intended for use with "prime editor," a chimeric fusion of a CRISPR/Cas9 protein and a reverse-transcriptase domain, which utilizes a custom prime editing guide RNA (PEgRNA). By extension, Cas9 tools and homology-directed repair (HDR) pathways may also be exploited to introduce recombinase recognition sequences through DNA templates by lowering the rates of indels using several techniques[65-67]. A proof-of-concept experiment in human cell culture is shown in FIG. 65.

The following several tables are cited in the above description relating to PE-directed installation of recombinase recognition sequences and provide a listing of exemplary recombinases that may be used, and their cognate recombinase recognition sequences that may be installed by PE.

TABLE 7

Tyrosine recombinases and SSR target sequences.

| Recombinase | Recombinase recognition sequence | Name |
| --- | --- | --- |
| Cre | ATAACTTCGTATAGCATACATTATACGAAGTTAT (SEQ ID NO: 517) | loxP |
| Dre | TAACTTTAAATAATGCCAATTATTTAAAGTTA (SEQ ID NO: 518) | rox |
| VCre | TCAATTTCTGAGAACTGTCATTCTCGGAAATTGA (SEQ ID NO: 519) | loxV |
| SCre | CTCGTGTCCGATAACTGTAATTATCGGACATGAT (SEQ ID NO: 520) | loxS |
| Flp | GAAGTTCCTATTCTCTAGAAAGTATAGGAACTTC (SEQ ID NO: 521) | FRT |
| B2 | GAGTTTCATTAAGGAATAACTAATTCCCTAATGAA ACTC (SEQ ID NO: 522) | loxB |
| B3 | GGTTGCTTAAGAATAAGTAATTCTTAAGCAACC (SEQ ID NO: 523) | loxB3 |
| Kw | ACGAAAAATGGTAAGGAATAGACCATTCCTTACC ATTTTTGGT (SEQ ID NO: 524) | |
| R | TTGATGAAAGAATAACGTATTCTTTCATCAA (SEQ ID NO: 525) | RS |
| TD1-40 | GTGCGTCAAATAATAACGTATTATTTGACACTT (SEQ ID NO: 526) | TDRS |
| Vika | AATAGGTCTGAGAACGCCCATTCTCAGACGTATT (SEQ ID NO: 527) | vox |
| Nigri | TGAATGTCCTATAATTACACTTATAGGACATTCA (SEQ ID NO: 528) | nox |
| Panto | GAAACTTTAAATAATAAGTCTTATTTAAAGTTTC (SEQ ID NO: 529) | pox |
| Kd | TTATCAGACAAATGTCTGATATCGTTT (SEQ ID NO: 530) | loxK |

TABLE 7-continued

Tyrosine recombinases and SSR target sequences.

| Recombinase | Recombinase recognition sequence | Name |
|---|---|---|
| Fre | ATATATACGTATATAGACATATATACGTATATAT (SEQ ID NO: 531) | loxH |
| CreALSHG | ATAACTCTATATAATGTATGCTATATAGAGTTAT (SEQ ID NO: 532) | loxM7 |
| Tre | ACAACATCCTATTACACCCTATATGCCAACATGG (SEQ ID NO: 533) | loxLTR |
| Brec1 | AACCCACTGCTTAAGCCTCAATAAAGCTTGCCTT (SEQ ID NO: 534) | loxBTR |
| Cre-R3M3 | GATACAACGTATATACCTTTCTATACGTTGTTTA (SEQ ID NO: 535) | loxK2 |

TABLE 8

Large serine integrases and SSR target sequences.

| Recombinase | Recombinase recognition sequence Left | Recombinase recognition sequence Right |
|---|---|---|
| Bxb1 | GGTTTGTCTGGTCAACCACCGCGGTCTCAGTGGTGTACGGTACAAACC (SEQ ID NO: 536) | GGCTTGTCGACGACGGCGGTCTCCGTCGTCAGGATCAT (SEQ ID NO: 537) |
| phiC31 | GTGCCCCAACTGGGGTAACCTTTGAGTTCTCTCAGTTGGGGG (SEQ ID NO: 538) | TGCGGGTGCCAGGGCGTGCCCTTGGGCTCCCCGGGCGCGTACTCC (SEQ ID NO: 539) |
| R4 | TGTTCCCCAAAGCGATACCACTGAAGCAGTGGTACTGCTTGTGGGTACA (SEQ ID NO: 540) | GCATGTTCCCCAAAGCGATACCACTTGAAGCAGTGGTACTGCTTGTGGTACACTCTGCGGGTG (SEQ ID NO: 541) |
| phiBT1 | GGTGCTGGGTTGTTGTCTCTGGACAGTGATCCATGGGAAACTACTCAGCACC (SEQ ID NO: 542) | CAGGTTTTTGACGAAAGTGATCCAGATGATCCAG (SEQ ID NO: 543) |
| MJ1 (phiFC1) | ATTTTAGGTATATGATTTTGTTTATTAGTGTAAATAACACTATGTACCTAAAAT (SEQ ID NO: 544) | CAAAGGATCACTGAATCAAAGTATTGCTCATCCACGCGAAA (SEQ ID NO: 545) |
| MR11 | TTTGTGCGGAACTACGAACAGTTCATTAATACGAAGTGTACAAACTTCCATACAA (SEQ ID NO: 546) | CGAAAATGTATGGAGGCACTTGTATCAATATAGGATGTATACCTTCGAAGACACTT (SEQ ID NO: 547) |
| TP901-1 | GAGTTTTTATTTCGTTTATTTCAATTAAGGTAACTAAAAAACTCCTTTTAAGG (SEQ ID NO: 548) | ATGCCAACACAATTAACATCTCAATCAAGGTAAATGCTTTTTGCTTTTTTTGC (SEQ ID NO: 549) |
| A118 | TTCCTCGTTTTCTCTCGTTGGAAGAAGAAGAAACGAGAAA (SEQ ID NO: 550) | TTTCGGATCAAGCTATGAAGGACGCAAAGAGGGAACTAAA (SEQ ID NO: 551) |
| U153 | TTCCTCGTTTTCTCTCGTTGGACGGAAACGAATCGAGAAA (SEQ ID NO: 552) | TTTCGGATCAAGCTATGAAGGACGCAAAGAGGGAACTAAA (SEQ ID NO: 553) |
| phiRV1 | GTAGTGTATCTCACAGGTCCACGGTTGGCCGTGGACTGCTGAAGAACATTCC (SEQ ID NO: 554) | GAAGGTGTTGGTGCGGGGTTGGCCGTGGTCGAGGTGGGGT (SEQ ID NO: 555) |
| phi370.1 | AAAAAAATACAGCGTTTTTCATGTACAACTATACTAGTTGTAGTGCCTAAAA (SEQ ID NO: 556) | TTGTAAAGGAGACTGATAATGGCATGTACAACTATACTCGTCGGTAAAAAGGCA (SEQ ID NO: 557) |
| TG1 | TCCAGCCCAACAGTGTTAGTCTTTGCTCTTACCCAGTTGGGCGGGA (SEQ ID NO: 558) | GATCAGCTCCGCGGGCAAGACCTTTCTCCTTCACGGGGTGGAAGGTC (SEQ ID NO: 559) |
| WB | CTAGTTTTAAAGTTYGGTTATTAGTTACTGTGATATTTATCACGGTACCCAATAACCAATGAAT (SEQ ID NO: 560) | CGGAAGGTAGCGTCAACGATAGGTGTAACTGTCGTGTTTGTAACGTACTTCCAACAGCTGGCGCCGCCAC (SEQ ID NO: 561) |
| BL3 | CAATGAAAAACTAGGCATGTAGAAGTTGTTTGT (SEQ ID NO: 562) | TTTCCACAGACAACTCACGTGGAGGTAGTCAC (SEQ ID NO: 563) |

TABLE 8-continued

Large serine integrases and SSR target sequences.

| Recombinase | Recombinase recognition sequence Left | Recombinase recognition sequence Right |
|---|---|---|
| SprA | TGTAGTAAGTATCTTAATATAC AGCTTTATCTGTTTTTTAAGAT ACTTACTACTTT (SEQ ID NO: 564) | CACCCATTGTGTTCACAGGAGATA CAGCTTTATCTGTACTGATATTAAT GACATGCTG (SEQ ID NO: 565) |
| phiJoe | AGTTGTGGCCATGTGTCCATCT GGGGGCAGATGGAGACGGGGT CACA (SEQ ID NO: 566) | ATCTGGATGTGGGTGTCCATCTGCG GGCAGACGCCGCAGTCGAAGCACG G (SEQ ID NO: 567) |
| — | — | ACCTTGATCTCGGTGTCCATCGCCG GGCAGACGCCGCAGTCGAAGCACG G (SEQ ID NO: 568) |
| phiK38 | CCCTAATACGCAAGTCGATAA CTCTCCTGGGAGCGTTGACAAC TTGCGCACCCTGATCTG (SEQ ID NO: 569) | GAGCGCCGGATCAGGGAGTGGACG GCCTGGGAGCGCTACACGCTGTGG CTGCGGTCGGTGC (SEQ ID NO: 570) |
| Int2 | GCTCATGTATGTGTCTACGCGA GATTCTCGCCCGAGAACTTCTG CAAGGCACTGCTCTTGGCT (SEQ ID NO: 571) | GGACGGCGCAGAAGGGGAGTAGCT CTTCGCCGGACCGTCGACATACTG CTCAGCTCGTC (SEQ ID NO: 572) |
| Int3 | ATGGATAAAAAAATACAGCGT TTTTCATGTACAACTATACTAG TTGTAGTGCCTAAATAATGCTT (SEQ ID NO: 573) | GTTTGTAAAGGAGACTGATAATGG CATGTACAACTATACTCGTCGGTA AAAAGGCATCTTAT (SEQ ID NO: 574) |
| Int4 | AAAAATTACAAAGTTTTCAACC CTTGATTTGAATTAGCGGTCAA ATAATTTGTAATTCGTTT (SEQ ID NO: 575) | TTCCAAAGAGCGCCCAACGCGACC TGAAATTTGAATAAGACTGCTGCTT GTGTAAAGGCGATGATT (SEQ ID NO: 576) |
| Int7 | GT GTTATAAACCTGTGTGAGAG TTAAGTTTACATGCCTAACCTT AACTTTTACGCAGGTTCAGCTT (SEQ ID NO: 577) | AGACGAGAAACGTTCCGTCCGTCT GGGTCAGTTGGGCAAAGTTGATGA CCGGGTCGTCCGTT (SEQ ID NO: 578) |
| Int8 | TTAATAAACTATGGAAGTATGT ACAGTCTTGCAATGTTGAGTGA ACAAACTTCCATAATAAAT (SEQ ID NO: 579) | CAATCATCAGATAACTATGGCGGC ACGTGCATTAACCACGGTTGTATCC CGTCTAAAGTACTCGT (SEQ ID NO: 580) |
| Int9 | GTGGTTGTTTTTGTTGGAAGTG TGTATCAGGTATCTGCATAGTT ATTCCGAACTTCCAATTA (SEQ ID NO: 581) | TTTATATTGCGAAAAATAATTGGC GAACGAGGTAACTGGATACCTCAT CCGCCAATTAAAATTTG (SEQ ID NO: 582) |
| Int10 | GGAAAATATAAATAATTTTAGT AACCTACATCTCAATCAAGGATACCAAC AGTAAAACTCTCACTCTT (SEQ ID NO: 583) | AGC AC GCTGATAATCAGC AAGACC ATTTCCACCAATGTAAAA GCTTTAACCTTAGC (SEQ ID NO: 584) |
| Int 11 | GTTTATATGTTTACTAATAAGA CGCTCTCAACCCATAAAGTCTT ATTAGTAAACATATTTCAACT (SEQ ID NO: 585) | ATGGATTTTGCAGATTCCCAGATGC CCCTACAGAAAGAGGTACAAAACA TTTATTGGAATTAATT (SEQ ID NO: 586) |
| Int12 | TTTTTGTATGTTAGTTGTGTCA CTGGGTAGACCTAAATAGTGA CACAACTGCTATTAAAATTTAA (SEQ ID NO: 587) | GTTCGTGGTAACTATGGGTGGTAC AGGTGCCACATTAGTTGTACCATTT ATGTTTATGTGGTTAAC (SEQ ID NO: 588) |
| Int13 | CAATAACGGTTGTATTTGTAGA ACTTGACCAGTTGTTTTAGTAA CATAAATACAACTCCGAATA (SEQ ID NO: 589) | GCATACATTGTTGTTGTTTTTCCAG ATCCAGTTGGTCCTGTAAATATAA GCAATCCATGTGAGT (SEQ ID NO: 590) |
| LI | GTTTAGTATCTCGTTATCTCTC GTTGGAGGGAGAAGAAACGGG ATACCAAAA(SEQ ID NO: 591) | TAACTTTTTCGGATCGAGTTATGAT GGACGTAAAGAGGGAACAAAGCA TCTA (SEQ ID NO: 592) |

TABLE 8-continued

Large serine integrases and SSR target sequences.

| Recombinase | Recombinase recognition sequence Left | Recombinase recognition sequence Right |
|---|---|---|
| Peaches | TAGTTTCCAATGTTACAGGAAC TGCTGGCAGAATCCAACACATT GGAAGTCG(SEQ ID NO: 593) | CGGTCTCCATCGGGATCTGCTGATC GAGCAGCATGCCGACCA (SEQ ID NO: 594) |
| Bxz2 | TAACCGCAAGTGTACATCCCTC GGCTGGCCGAGACAAGTACAG TTGCGACAG(SEQ ID NO: 595) | CGGTCTCCATCGGGATCTGCTGATC GAGCAGCATGCCGACCA (SEQ ID NO: 596) |
| SV1 | ATGTGGTCCTTTAGATCCACTG ACGTGGGTCAGTGTCTCTAAAG GACTCGCG(SEQ ID NO: 597) | CATCAGGGCGGTCAGGCCGTAGAT GTGGAAGAAACGGCAGCACGGCG AGGACG (SEQ ID NO: 598) |

TABLE 9

Serine resolvases and SSR target sequences.

| Resolvase | Recombinase recognition sequence Left | Recombinase recognition sequence Right |
|---|---|---|
| Gin | CGTTTCCTGTAAACCGAGGTTTTG GATAAACA (SEQ ID NO: 599) | CGTTTCCTGTAAACCGAGGTTTTG GATAATGG (SEQ ID NO: 600) |
| Cin | GAGTTCTCTTAAACCAAGGTTTA GGATTGAAA (SEQ ID NO: 601) | GAGTTCTCTTAAACCAAGGTATT GGATAACAG (SEQ ID NO: 602) |
| Hin | TGGTTCTTGAAAACCAAGGTTTTT GATAAAGC (SEQ ID NO: 603) | AAATTTTCCTTTTTGGAAGGTTTT TGATAACCA (SEQ ID NO: 604) |
| Min | GCCTTCCCCTAAACCAACGTTTTT ATGCCGCC (SEQ ID NO: 605) | GCCTTCCCCCAAACCAAGGTAAT CAAGAACGC (SEQ ID NO: 606) |
| Sin | TTGTGAAATTTGGGTACACCCTA ATCATACAA (SEQ ID NO: 607) | CGTATGATTAGGGTGTATATTAA TTT (SEQ ID NO: 608) |

TABLE 10

Tyrosine integrases and target sequences.

| Integrase | attP | attB |
|---|---|---|
| HK022 | CAAATGATTTTATTTTGACTAATAA TGACCTACTTACATTAATTTACTGAT AATTAAAGAGATTTTAAATATACAA CTTATTCACCTAAAGGATGACAAAA (SEQ ID NO: 609) | GCACTTTAGGTGAAAAAGGTT (SEQ ID NO: 610) |
| | TAACATTAATCACTTAAAAATCATC GCATTACACTAATCTGTGGTTAAAT GATAGACTACATAATGCGACAAAA CGCAACATATCCAGTCACTATGAAT CAACTACTTAGATAGTATTAGTGAC CT (SEQ ID NO: 611) | |
| P22 | CTAAGTGGTTTGGGACAAAAATGGG ACATACAAATCTTTGCATCGGTTTG CAAGGCTTTGCATGTCTTTCGAAGA TGGGACGTGTGAGCGCAGGTATGAC GTGGTATGTGTTGACTTAAAAGGTA GTTCTTATAATTCGTAATGCGAAGG TCGTAGGTTCGACTCCTATTATCGG CACCAGTTAAATCAAATACTTACGT ATTATTCGTGCCTTCCTTATTTTTAC TGTGGGACATATTTGGGACAGAAGT ACCAAAAA (SEQ ID NO: 612) | GCAGCGCATTCGTAATGCGA AGGTCGT (SEQ ID NO: 613) |

TABLE 10 -continued

Tyrosine integrases and target sequences.

| Integrase | attP | attB |
|---|---|---|
| L5 | GCGATCCCCATCCGCGACGTGCCAA CTAGGTCTCCTCTCGTCGTGAACAA GGCTACCGGGTTGCAACTCCTGTC AACTCTCAGGCTTCAACGCGCTTCT ACGACCTGCAATTTCTTTCCACTTA GAGGATGCAGCCGAGAGGGGTAAA AACCTATCTTGACCGGCCCATATGT GGTCGGCAGACACCCATTCTTCCAA ACTAGCTACGCGGGTTCGATTCCCG TCGCCCGCTCCGCTGGTCAGAGGGT GTTTTCGCCCTCTGGCCATTTTTCTT TCCAGGGGTCTGCAACTCTTGTGCG ACTCTTCTGACCTGGGCATACGCGG TTGCAACGCATCCCTGATCTGGCTA CTTTCGATGCTGACAAACGAATAGA GCCCCCCGCCTGCGCGAACAGACG AGGGGCATTCACA (SEQ ID NO: 614) | GAGCGGGCGACGGGAATCG AACCCGCGTAGCTAGTTTGG AAGA (SEQ ID NO: 615) |

In various other aspects, the present disclosure relates to methods of using PE to install one or more recombinase recognition sequence and their use in site-specific recombination.

In some embodiments, the site-specific recombination may effecuate a variety of recombination outcomes, such as, excision, integration, inversion, or exchange of DNA fragments.

In some embodiments, the methods are useful for inducing recombination of or between two or more regions of two or more nucleic acid (e.g., DNA) molecules. In other embodiments, the methods are useful for inducing recombination of or between two or more regions in a single nucleic acid molecule (e.g., DNA).

In some embodiments, the disclosure provides a method for integrating a donor DNA template by site-specific recombination, comprising: (a) installing a recombinase recognition sequence at a genomic locus by prime editing; (b) contacting the genomic locus with a DNA donor template that also comprises the recombinase recognition sequence in the presence of a recombinase.

In other embodiments, the disclosure provides a method for deleting a genomic region by site-specific recombination, comprising: (a) installing a pair of recombinase recognition sequences at a genomic locus by prime editing; (b) contacting the genomic locus with a recombinase, thereby catalyzing the deletion of the genomic region between the pair of recombinase recognition sequences.

In yet other embodiments, the disclosure provides a method for inverting a genomic region by site-specific recombination, comprising: (a) installing a pair of recombinase recognition sequences at a genomic locus by prime editing; (b) contacting the genomic locus with a recombinase, thereby catalyzing the inversion of the genomic region between the pair of recombinase recognition sequences.

In still other embodiments, the disclosure provides a method for inducing chromosomal translocation between a first genomic site and a second genomic site, comprising: (a) installing a first recombinase recognition sequence at a first genomic locus by prime editing; (b) installing a second recombinase recognition sequence at a second genomic locus by prime editing; (c) contacting the first and the second genomic loci with a recombinase, thereby catalyzing the chromosomal translocation of the first and second genomic loci.

In other embodiments, the disclosure provides a method for inducing cassette exchange between a genomic locus and a donor DNA comprising a cassette, comprising: (a) installing a first recombinase recognition sequence at a first genomic locus by prime editing; (b) installing a second recombinase recognition sequence at a second genomic locus by prime editing; (c) contacting the first and the second genomic loci with a donor DNA comprising a cassette that is flanked by the first and second recombinase recognition sequences and a recombinase, thereby catalyzing the exchange of the flanked genomic locus and the cassette in the DNA donor.

In various embodiments involving the insertion of more than one recombinase recognition sequences in the genome, the recombinase recognition sequences can be the same or different. In some embodiments, the recombinase recognition sequences are the same. In other embodiments, that recombinase recognition sequences are different.

In various embodiments, the recombinase can be a tyrosine recombinase, such as Cre, Dre, Vcre, Scre, Flp, B2, B3, Kw, R, TD1-40, Vika, Nigri, Panto, Kd, Fre, Cre(ALSHG), Tre, Brec1, or Cre-R3M3, as shown in Table 7. In such embodiments, the recombinase recognition sequence may be an RRS of Table 7 that corresponds to the recombinase under use.

In various other embodiments, the recombinase can be a large serine recombinase, such as Bxb1, PhiC31, R4, phiBT1, MJ1, MR11, TP901-1, A118, V153, phiRV1, phi370.1, TG1, WB, BL3, SprA, phiJoe, phiK38, Int2, Int3, Int4, Int7, Int8, Int9, Int10, Int11, Int12, Int13, L1, peaches, Bxz2, or SV1, as shown in Table 8. In such embodiments, the recombinase recognition sequence may be an RRS of Table 8 that corresponds to the recombinase under use.

In still other embodiments, the recombinase can be a serine recombinase, such as Bxb1, PhiC31, R4, phiBT1, MJ1, MR11, TP901-1, A118, V153, phiRV1, phi370.1, TG1, WB, BL3, SprA, phiJoe, phiK38, Int2, Int3, Int4, Int7, Int8, Int9, Int10, Int11, Int12, Int13, L1, peaches, Bxz2, or SV1, as shown in Table 8. In such embodiments, the recombinase recognition sequence may be an RRS of Table 8 that corresponds to the recombinase under use.

In other embodiments, the recombinase can be a serine resolvase, such as Gin, Cin, Hin, Min, or Sin, as shown in Table 9. In such embodiments, the recombinase recognition sequence may be an RRS of Table 9 that corresponds to the recombinase under use.

In various other embodiments, the recombinase can be a tyrosine integrase, such as HK022, P22, or L5, as shown in Table 10. In such embodiments, the recombinase recognition sequence may be an RRS of Table 10 that corresponds to the recombinase under use.

In some embodiments, any of the methods for site-specific recombination with PE can be performed in vivo or in vitro. In some embodiments, any of the methods for site-specific recombination are performed in a cell (e.g., recombine genomic DNA in a cell). The cell can be prokaryotic or eukaryotic. The cell, such as a eukaryotic cell, can be in an individual, such as a subject, as described herein (e.g., a human subject). The methods described herein are useful for the genetic modification of cells in vitro and in vivo, for example, in the context of the generation of transgenic cells, cell lines, or animals, or in the alteration of genomic sequence, e.g., the correction of a genetic defect, in a cell in a subject.

References Cited for Section L

Each of the following references are cited in Example 17, each of which are incorporated herein by reference.
1. Feuk, L. Inversion variants in the human genome: role in disease and genome architecture. Genome Med 2, 11 (2010).
2. Zhang, F., Gu, W., Hurles, M. E. & Lupski, J. R. Copy number variation in human health, disease, and evolution. Annu Rev Genomics Hum Genet 10, 451-481 (2009).
3. Shaw, C. J. & Lupski, J. R. Implications of human genome architecture for rearrangement-based disorders: the genomic basis of disease. Hum Mol Genet 13 Spec No 1, R57-64 (2004).
4. Carvalho, C. M., Zhang, F. & Lupski, J. R. Evolution in health and medicine Sackler colloquium: Genomic disorders: a window into human gene and genome evolution. Proc Natl Acad Sci USA 107 Suppl 1, 1765-1771 (2010).
5. Rowley, J. D. Chromosome translocations: dangerous liaisons revisited. Nat Rev Cancer 1, 245-250 (2001).
6. Aplan, P. D. Causes of oncogenic chromosomal translocation. Trends Genet 22, 46-55 (2006).
7. McCarroll, S. A. & Altshuler, D. M. Copy-number variation and association studies of human disease. Nat Genet 39, S37-42 (2007).

[8] Methods of Treatment

The instant disclosure provides methods for the treatment of a subject diagnosed with a disease associated with or caused by a point mutation, or other mutations (e.g., deletion, insertion, inversion, duplication, etc.) that can be corrected by the prime editing system provided herein, as exemplified, but not limited to prion disease (e.g., Example 5 herein), trinucleotide repeat expansion disease (e.g., Example 3 herein), or CDKL5 Deficiency Disorder (CDD) (e.g., Example 23 herein).

Virtually any disease-causing genetic defect may be repaired by using prime editing, which includes the selection of an appropriate prime editor fusion protein (including a napDNAbp and a polymerase (e.g., a reverse transcriptase), and designing of an appropriate PEgRNA designed to (a) target the appropriate target DNA containing an edit site, and (b) provide a template for the synthesis of a single strand of DNA from the 3' end of the nick site that includes the desired edit which displaces and replaces the endogenous strand immediately downstream of the nick site. Prime editing can be used, without limitation, to (a) install mutation-correcting changes to a nucleotide sequence, (b) install protein and RNA tags, (c) install immunoepitopes on proteins of interest, (d) install inducible dimerization domains in proteins, (e) install or remove sequences to alter that activity of a biomolecule, (f) install recombinase target sites to direct specific genetic changes, and (g) mutagenesis of a target sequence by using an error-prone RT.

The method of treating a disorder can involve as an early step the design of an appropriate PEgRNA and prime editor fusion protein in accordance with the methods described herein, which include a number of considerations that may be taken into account, such as:
(a) the target sequence, i.e., the nucleotide sequence in which one or more nucleobase modifications are desired to be installed by the prime editor;
(b) the location of the cut site within the target sequence, i.e., the specific nucleobase position at which the prime editor will induce a single-stand nick to create a 3' end RT primer sequence on one side of the nick and the 5' end endogenous flap on the other side of the nick (which ultimately is removed by FEN1 or equivalent thereto and replaced by the 3' ssDNA flap. The cut site creates the 3' end primer sequence which becomes extended by the polymerase of the PE fusion protein (e.g., a RT enzyme) during RNA-dependent DNA polymerization to create the 3' ssDNA flap containing the desired edit, which then replaces the 5' endogenous DNA flap in the target sequence.
(c) the available PAM sequences (including the canonical SpCas9 PAM sites, as well as non-canonical PAM sites recognized by Cas9 variants and equivalents with expanded or differing PAM specificities);
(d) the spacing between the available PAM sequences and the location of the cut site in the PAM strand;
(e) the particular Cas9, Cas9 variant, or Cas9 equivalent of the prime editor available to be used (which in part is dictated by the available PAM);
(f) the sequence and length of the primer binding site;
(g) the sequence and length of the edit template;
(h) the sequence and length of the homology arm;
(i) the spacer sequence and length; and
(j) the gRNA core sequence.

A suitable PEgRNA, and optionally a nicking-sgRNA design guide for second-site nicking, can be designed by way of the following exemplary step-by-step set of instructions which takes into account one or more of the above considerations. The steps reference the examples shown in FIGS. 70A-70I.

1. Define the target sequence and the edit. Retrieve the sequence of the target DNA region (~200 bp) centered around the location of the desired edit (point mutation, insertion, deletion, or combination thereof). See FIG. 70A.

2. Locate target PAMs. Identify PAMs in the proximity to the desired edit location. PAMs can be identified on either strand of DNA proximal to the desired edit location. While PAMs close to the edit position are preferred (i.e., wherein the nick site is less than 30 nt from the edit position, or less than 29 nt, 28 nt, 27 nt, 26 nt, 25 nt, 24 nt, 23 nt, 22 nt, 21 nt, 20 nt, 19 nt, 18 nt, 17 nt, 16 nt, 15 nt, 14 nt, 13 nt, 12 nt, 11 nt, 10 nt, 9 nt, 8 nt, 7 nt, 6 nt, 5 nt, 4 nt, 3 nt, or 2 nt from the edit position to the nick site), it is possible to install edits using protospacers and PAMs that place the nick >30 nt from the edit position. See FIG. 70B.

3. Locate the nick sites. For each PAM being considered, identify the corresponding nick site and on which strand. For Sp Cas9 H840A nickase, cleavage occurs in the PAM-containing strand between the $3^{rd}$ and $4^{th}$ bases 5' to the NGG PAM. All edited nucleotides must exist 3' of the nick site, so appropriate PAMs must place the nick 5' to the target edit on the PAM-containing strand. In the example shown below, there are two possible PAMs. For simplicity, the remaining steps will demonstrate the design of a PEgRNA using PAM 1 only. See FIG. 70C.

4. Design the spacer sequence. The protospacer of SpCas9 corresponds to the 20 nucleotides 5' to the NGG PAM on the PAM-containing strand. Efficient Pol III transcription initiation requires a G to be the first transcribed nucleotide. If the first nucleotide of the protospacer is a G, the spacer sequence for the PEgRNA is simply the protospacer sequence. If the first nucleotide of the protospacer is not a G, the spacer sequence of the PEgRNA is G followed by the protospacer sequence. See FIG. 70D.

5. Design a primer binding site (PBS). Using the starting allele sequence, identify the DNA primer on the PAM-containing strand. The 3' end of the DNA primer is the nucleotide just upstream of the nick site (i.e. the $4^{th}$ base 5' to the NGG PAM for Sp Cas9). As a general design principle for use with PE2 and PE3, a PEgRNA primer binding site (PBS) containing 12 to 13 nucleotides of complementarity to the DNA primer can be used for sequences that contain ~40-60% GC content. For sequences with low GC content, longer (14- to 15-nt) PBSs should be tested. For sequences with higher GC content, shorter (8- to 11-nt) PBSs should be tested. Optimal PBS sequences should be determined empirically, regardless of GC content. To design a length-p PBS sequence, take the reverse complement of the first p nucleotides 5' of the nick site in the PAM-containing strand using the starting allele sequence. See FIG. 70E.

6. Design an RT template (or DNA synthesis template). The RT template (or DNA synthesis template where the polymerase is not reverse transcriptase) encodes the designed edit and homology to the sequence adjacent to the edit. In one embodiment, these regions correspond to the DNA synthesis template of FIG. 3D and FIG. 3E, wherein the DNA synthesis template comprises the "edit template" and the "homology arm." Optimal RT template lengths vary based on the target site. For short-range edits (positions +1 to +6), it is recommended to test a short (9 to 12 nt), a medium (13 to 16 nt), and a long (17 to 20 nt) RT template. For long-range edits (positions +7 and beyond), it is recommended to use RT templates that extend at least 5 nt (preferably 10 or more nt) past the position of the edit to allow for sufficient 3' DNA flap homology. For long-range edits, several RT templates should be screened to identify functional designs. For larger insertions and deletions (≥5 nt), incorporation of greater 3' homology (~20 nt or more) into the RT template is recommended. Editing efficiency is typically impaired when the RT template encodes the synthesis of a G as the last nucleotide in the reverse transcribed DNA product (corresponding to a C in the RT template of the PEgRNA). As many RT templates support efficient prime editing, avoidance of G as the final synthesized nucleotide is recommended when designing RT templates. To design a length-r RT template sequence, use the desired allele sequence and take the reverse complement of the first r nucleotides 3' of the nick site in the strand that originally contained the PAM. Note that compared to SNP edits, insertion or deletion edits using RT templates of the same length will not contain identical homology. See FIG. 70F.

7. Assemble the full PEgRNA sequence. Concatenate the PEgRNA components in the following order (5' to 3'): spacer, scaffold, RT template and PBS. See FIG. 70G.

8. Designing nicking-sgRNAs for PE3. Identify PAMs on the non-edited strand upstream and downstream of the edit. Optimal nicking positions are highly locus-dependent and should be determined empirically. In general, nicks placed 40 to 90 nucleotides 5' to the position across from the PEgRNA-induced nick lead to higher editing yields and fewer indels. A nicking sgRNA has a spacer sequence that matches the 20-nt protospacer in the starting allele, with the addition of a 5'-G if the protospacer does not begin with a G. See FIG. 70H.

9. Designing PE3b nicking-sgRNAs. If a PAM exists in the complementary strand and its corresponding protospacer overlaps with the sequence targeted for editing, this edit could be a candidate for the PE3b system. In the PE3b system, the spacer sequence of the nicking-sgRNA matches the sequence of the desired edited allele, but not the starting allele. The PE3b system operates efficiently when the edited nucleotide(s) falls within the seed region (~10 nt adjacent to the PAM) of the nicking-sgRNA protospacer. This prevents nicking of the complementary strand until after installation of the edited strand, preventing competition between the PEgRNA and the sgRNA for binding the target DNA. PE3b also avoids the generation of simultaneous nicks on both strands, thus reducing indel formation significantly while maintaining high editing efficiency. PE3b sgRNAs should have a spacer sequence that matches the 20-nt protospacer in the desired allele, with the addition of a 5' G if needed. See FIG. 70I.

The above step-by-step process for designing a suitable PEgRNA and a second-site nicking sgRNA is not meant to be limiting in any way. The disclosure contemplates variations of the above-described step-by-step process which would be derivable therefrom by a person of ordinary skill in the art.

Once a suitable PEgRNA and PE fusion protein are selected/designed, they may be administered by a suitable methodology, such as by vector-based transfection (in which one or more vectors comprising DNA encoding the PEgRNA and the PE fusion protein and which are expressed within a cell upon transfection with the vectors), direct delivery of the PE fusion protein complexed with the PEgRNA (e.g., RNP delivery) in a delivery format (e.g., lipid particles, nanoparticles), or by a mRNA-based delivery system. Such methods are described herein in the present disclosure and any know method may be utilized.

The PEgRNA and PE fusion protein (or together, referred to as the PE complex) can be delivered to a cell in a therapeutically effective amount such that upon contacting the target DNA of interest, the desired edit becomes installed therein.

Any disease is conceivably treatable by such methods so long as delivery to the appropriate cells is feasible. The person having ordinary skill in the art will be able to choose and/or select a PE delivery methodology to suit the intended purpose and the intended target cells.

For example, in some embodiments, a method is provided that comprises administering to a subject having such a disease, e.g., a cancer associated with a point mutation as described above, an effective amount of the prime editing system described herein that corrects the point mutation or introduces a deactivating mutation into a disease-associated gene as mediated by homology-directed repair in the presence of a donor DNA molecule comprising desired genetic change. In some embodiments, a method is provided that comprises administering to a subject having such a disease, e.g., a cancer associated with a point mutation as described above, an effective amount of the prime editing system described herein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by TPRT-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Ase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent porphyria; deficiency of Acyl-CoA dehydrogenase family, member 9; Adams-Oliver syndrome 5 and 6; Adenine phosphoribosyltransferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-1-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, IIA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TARDBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; Atrophia bulborum hereditaria; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis laxa type IA and 1B; Autosomal recessive hypohidrotic ectodermal dysplasia syndrome; Ectodermal dysplasia 11b; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and epicanthus inversus; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glucosuria, and nuclear diffuse nonprogressive; Catecholaminergic polymorphic ventricular tachycardia; Caudal regression syndrome; Cd8 deficiency, familial; Central core disease; Centromeric instability of chromosomes 1,9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facio-skeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; Chondrodysplasia Blomstrand type; Chondrodysplasia punctata 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A; Coenzyme Q10 deficiency, primary 1, 4, and 7; Coffin Siris/Intellectual Disability; Coffin-Lowry syndrome; Cohen syndrome; Cold-induced sweating syndrome 1; COLE-CARPENTER SYNDROME 2; Combined cellular and humoral immune defects with granulomas; Combined d-2- and 1-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional cl inhibitor; Complement factor B deficiency; Cone monochromatism; Cone-rod dystrophy 2 and 6; Cone-rod dystrophy amelogenesis imperfecta; Congenital adrenal hyperplasia and Congenital adrenal hypoplasia, X-linked; Congenital amegakaryocytic thrombocytopenia; Congenital aniridia; Congenital central hypoventilation; Hirschsprung disease 3; Congenital contractural arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic porphyria; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillous atrophy; Congenital muscular dystrophy; Congenital muscular dystrophy due to partial LAMA2 deficiency; Congenital muscular dystrophy-dystroglycanopathy with brain and eye anomalies, types A2, A7, A8, A11, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis laxa with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulin-dependent, 20; Diamond-Blackfan anemia 1, 5, 8, and 10; Diarrhea 3 (secretory sodium, congenital, syndromic) and 5 (with tufting enteropathy, congenital); Dicarboxylic aminoaciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 1I, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial porphyria cutanea tarda; Familial pulmonary capillary hemangiomatosis; Familial renal glucosuria; Familial renal hypouricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia 1and 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-biphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Glutathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome; Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB amd IIA; Hereditary sideroblastic anemia; Hermansky-Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2, 3,7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cblE complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hyperphosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and acanthosis *nigricans*; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; lodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris striata 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalencephalic leukoencephalopathy with subcortical cysts 1and 2a; Megalencephaly cutis marmorata telangiectatica congenital; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness; Meier-Gorlin syndromes 1and 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, Hedera type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria; Methylmalonic aciduria cb1B type; Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvement) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types 1and 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP guanine oxidase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type 1and type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild chondrodysplasia; Osteochondritis dissecans; Osteogenesis imperfecta type 12, type 5, type 7, type 8, type I, type III, with normal sclerae, dominant form, recessive perinatal lethal; Osteopathia striata with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1; Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; *Porphyria cutanea tarda*; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase 1/3 deficiency; Prostate cancer, hereditary, 2; Protan defect; Proteinuria; Finnish congenital nephrotic syndrome; Proteus syndrome; Breast adenocarcinoma; Pseudoachondroplastic spondyloepiphyseal dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic chondrodysplasia punctata type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantil types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5; Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2;

Spastic ataxia 5, autosomal recessive, Charlevoix-Saguenay type, 1,10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1; Kniest dysplasia; Stickler syndrome, types 1(nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, 1b; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate porphyria; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types 1and 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weissenbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with steryl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

The target nucleotide sequence may comprise a target sequence (e.g., a point mutation) associated with a disease, disorder, or condition. The target sequence may comprise a T to C (or A to G) point mutation associated with a disease, disorder, or condition, and wherein the deamination of the mutant C base results in mismatch repair-mediated correction to a sequence that is not associated with a disease, disorder, or condition. The target sequence may comprise a G to A (or C to T) point mutation associated with a disease, disorder, or condition, and wherein the deamination of the mutant A base results in mismatch repair-mediated correction to a sequence that is not associated with a disease, disorder, or condition. The target sequence may encode a protein, and where the point mutation is in a codon and results in a change in the amino acid encoded by the mutant codon as compared to a wild-type codon. The target sequence may also be at a splice site, and the point mutation results in a change in the splicing of an mRNA transcript as compared to a wild-type transcript. In addition, the target may be at a non-coding sequence of a gene, such as a promoter, and the point mutation results in increased or decreased expression of the gene.

Thus, in some aspects, the deamination of a mutant C results in a change of the amino acid encoded by the mutant codon, which in some cases can result in the expression of a wild-type amino acid. In other aspects, the deamination of a mutant A results in a change of the amino acid encoded by the mutant codon, which in some cases can result in the expression of a wild-type amino acid.

The methods described herein involving contacting a cell with a composition or rAAV particle can occur in vitro, ex vivo, or in vivo. In certain embodiments, the step of contacting occurs in a subject. In certain embodiments, the subject has been diagnosed with a disease, disorder, or condition.

In some embodiments, the methods disclosed herein involve contacting a mammalian cell with a composition or rAAV particle. In particular embodiments, the methods involve contacting a retinal cell, cortical cell or cerebellar cell.

The split Cas9 protein or split prime editor delivered using the methods described herein preferably have comparable activity compared to the original Cas9 protein or prime editor (i.e., unsplit protein delivered to a cell or expressed in a cell as a whole). For example, the split Cas9 protein or split prime editor retains at least 50% (e.g., at least 50%, at least 60%, at least 70%, at least 80%, at least 90%, at least 95%, at least 98%, at least 99%, or 100%) of the activity of the original Cas9 protein or prime editor. In some embodiments, the split Cas9 protein or split prime editor is more active (e.g., 2-fold, 5-fold, 10-fold, 100-fold, 1000-fold, or more) than that of an original Cas9 protein or prime editor.

The compositions described herein may be administered to a subject in need thereof in a therapeutically effective amount to treat and/or prevent a disease or disorder the subject is suffering from. Any disease or disorder that maybe treated and/or prevented using CRISPR/Cas9-based genome-editing technology may be treated by the split Cas9 protein or the split prime editor described herein. It is to be understood that, if the nucleotide sequences encoding the split Cas9 protein or the prime editor does not further encode a gRNA, a separate nucleic acid vector encoding the gRNA may be administered together with the compositions described herein.

Exemplary suitable diseases, disorders or conditions include, without limitation the disease or disorder is selected from the group consisting of: cystic fibrosis, phenylketonuria, epidermolytic hyperkeratosis (EHK), chronic obstructive pulmonary disease (COPD), Charcot-Marie-Toot disease type 4J, neuroblastoma (NB), von Willebrand disease (vWD), myotonia congenital, hereditary renal amyloidosis, dilated cardiomyopathy, hereditary lymphedema, familial Alzheimer's disease, prion disease, chronic infantile neurologic cutaneous articular syndrome (CINCA), congenital deafness, Niemann-Pick disease type C (NPC) disease, and desmin-related myopathy (DRM). In particular embodiments, the disease or condition is Niemann-Pick disease type C (NPC) disease.

In some embodiments, the disease, disorder or condition is associated with a point mutation in an NPC gene, a DNMT] gene, a PCSK9 gene, or a TMC1 gene. In certain embodiments, the point mutation is a T3182C mutation in NPC, which results in an I1061T amino acid substitution.

In certain embodiments, the point mutation is an A545G mutation in TMC1, which results in a Y182C amino acid substitution. TMC1 encodes a protein that forms mechanosensitive ion channels in sensory hair cells of the inner ear and is required for normal auditory function. The Y182C amino acid substitution is associated with congenital deafness.

In some embodiments, the disease, disorder or condition is associated with a point mutation that generates a stop codon, for example, a premature stop codon within the coding region of a gene.

Additional exemplary diseases, disorders and conditions include cystic fibrosis (see, e.g., Schwank et al., Functional repair of CFTR by CRISPR/Cas9 in intestinal stem cell organoids of cystic fibrosis patients. *Cell stem cell.* 2013; 13: 653-658; and Wu et. al., Correction of a genetic disease in mouse via use of CRISPR-Cas9. *Cell stem cell.* 2013; 13: 659-662, neither of which uses a deaminase fusion protein to correct the genetic defect); phenylketonuria—e.g., phenylalanine to serine mutation at position 835 (mouse) or 240 (human) or a homologous residue in phenylalanine hydroxylase gene (T>C mutation)—see, e.g., McDonald et al., *Genomics.* 1997; 39:402-405; Bernard-Soulier syndrome (BSS)—e.g., phenylalanine to serine mutation at position 55 or a homologous residue, or cysteine to arginine at residue 24 or a homologous residue in the platelet membrane glycoprotein IX (T>C mutation)—see, e.g., Noris et al., *British Journal of Haematology.* 1997; 97: 312-320, and Ali et al., *Hematol.* 2014; 93: 381-384; epidermolytic hyperkeratosis (EHK)—e.g., leucine to proline mutation at position 160 or 161 (if counting the initiator methionine) or a homologous residue in keratin 1 (T>C mutation)—see, e.g., Chipev et al., *Cell.* 1992; 70: 821-828, see also accession number P04264 in the UNIPROT database at www[dot] uniprot[dot]org; chronic obstructive pulmonary disease (COPD)—e.g., leucine to proline mutation at position 54 or 55 (if counting the initiator methionine) or a homologous residue in the processed form of $\alpha_1$-antitrypsin or residue 78 in the unprocessed form or a homologous residue (T>C mutation)—see, e.g., Poller et al., *Genomics.* 1993; 17: 740-743, see also accession number P01011 in the UNIPROT database; Charcot-Marie-Toot disease type 4J—e.g., isoleucine to threonine mutation at position 41 or a homologous residue in FIG. 4 (T>C mutation)—see, e.g., Lenk et al., *PLoS Genetics.* 2011; 7: e1002104; neuroblastoma (NB)—e.g., leucine to proline mutation at position 197 or a homologous residue in Caspase-9 (T>C mutation)—see, e.g., Kundu et al., 3 *Biotech.* 2013, 3:225-234; von Willebrand disease (vWD)—e.g., cysteine to arginine mutation at position 509 or a homologous residue in the processed form of von Willebrand factor, or at position 1272 or a homologous residue in the unprocessed form of von Willebrand factor (T>C mutation)—see, e.g., Lavergne et al., *Br. J. Haematol.* 1992, see also accession number P04275 in the UNIPROT database; 82: 66-72; myotonia congenital—e.g., cysteine to arginine mutation at position 277 or a homologous residue in the muscle chloride channel gene CLCN1 (T>C mutation)—see, e.g., Weinberger et al., *The J. of Physiology.* 2012; 590: 3449-3464; hereditary renal amyloidosis—e.g., stop codon to arginine mutation at position 78 or a homologous residue in the processed form of apolipoprotein AII or at position 101 or a homologous residue in the unprocessed form (T>C mutation)—see, e.g., Yazaki et al., *Kidney Int.* 2003; 64: 11-16; dilated cardiomyopathy (DCM)—e.g., tryptophan to Arginine mutation at position 148 or a homologous residue in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 or a homologous residue in VEGFR3 tyrosine kinase (A>G mutation), see, e.g., Irrthum et al., *Am. J. Hum. Genet.* 2000; 67: 295-301; familial Alzheimer's disease—e.g., isoleucine to valine mutation at position 143 or a homologous residue in presenilin1 (A>G mutation), see, e.g., Gallo et. al., *J. Alzheimer's disease.* 2011; 25: 425-431; Prion disease—e.g., methionine to valine mutation at position 129 or a homologous residue in prion protein (A>G mutation)—see, e.g., Lewis et. al., *J. of General Virology.* 2006; 87: 2443-2449; chronic infantile neurologic cutaneous articular syndrome (CINCA)—e.g., Tyrosine to Cysteine mutation at position 570 or a homologous residue in cryopyrin (A>G mutation)—see, e.g., Fujisawa et. al. *Blood.* 2007; 109: 2903-2911; and desmin-related myopathy (DRM)—e.g., arginine to glycine mutation at position 120 or a homologous residue in $\alpha\beta$ crystallin (A>G mutation)—see, e.g., Kumar et al., *J. Biol. Chem.* 1999; 274: 24137-24141. The entire contents of all references and database entries is incorporated herein by reference.

Trinucleotide Repeat Expansion Disease

Trinucleotide repeat expansion is associated with a number of human diseases, including Huntington's Disease, Fragile X syndrome, and Friedreich's ataxia. The most common trinucleotide repeat contains CAG triplets, though GAA triplets (Friedreich's ataxia) and CGG triplets (Fragile X syndrome) also occur. Inheriting a predisposition to expansion, or acquiring an already expanded parental allele, increases the likelihood of acquiring the disease. Pathogenic expansions of trinucleotide repeats could hypothetically be corrected using prime editing.

A region upstream of the repeat region can be nicked by an RNA-guided nuclease, then used to prime synthesis of a new DNA strand that contains a healthy number of repeats (which depends on the particular gene and disease), in accordance with the general mechanism outlined in FIG. 1G or FIG. 22. After the repeat sequence, a short stretch of homology is added that matches the identity of the sequence adjacent to the other end of the repeat (red strand). Invasion of the newly synthesized strand by the TPRT system, and subsequent replacement of the endogenous DNA with the newly synthesized flap, leads to a contracted repeat allele. The term "contracted" refers to a shortening of the length of the nucleotide repeat region, thereby resulting in repairing the trinucleotide repeat region.

The prime editing system or prime editing (PE) system described herein may be used to contract trinucleotide repeat mutations (or "triplet expansion diseases") to treating conditions such as Huntington's disease and other trinucleotide repeat disorders. Trinucleotide repeat expansion disorders are complex, progressive disorders that involve developmental neurobiology and often affect cognition as well as sensori-motor functions. The disorders show genetic anticipation (i.e. increased severity with each generation). The DNA expansions or contractions usually happen meiotically (i.e. during the time of gametogenesis, or early in embryonic development), and often have sex-bias meaning that some genes expand only when inherited through the female, others only through the male. In humans, trinucleotide repeat expansion disorders can cause gene silencing at either the transcriptional or translational level, which essentially knocks out gene function. Alternatively, trinucleotide repeat expansion disorders can cause altered proteins generated with large repetitive amino acid sequences that either abrogate or change protein function, often in a dominant-negative manner (e.g. poly-glutamine diseases).

Without wishing to be bound by theory, triplet expansion is caused by slippage during DNA replication or during DNA repair synthesis. Because the tandem repeats have identical sequence to one another, base pairing between two DNA strands can take place at multiple points along the sequence. This may lead to the formation of "loop out" structures during DNA replication or DNA repair synthesis. This may lead to repeated copying of the repeated sequence, expanding the number of repeats. Additional mechanisms involving hybrid RNA:DNA intermediates have been proposed. Prime editing may be used to reduce or eliminate these triplet expansion regions by deletion one or more or the offending repeat codon triplets. In an embodiment of this use, FIG. 23, provides a schematic of a PEgRNA design for contracting or reducing trinucleotide repeat sequences with prime editing.

Prime editing may be implemented to contract triplet expansion regions by nicking a region upstream of the triplet repeat region with the prime editor comprising a PEgRNA appropriated targeted to the cut site. The prime editor then synthesizes a new DNA strand (ssDNA flap) based on the PEgRNA as a template (i.e., the edit template thereof) that codes for a healthy number of triplet repeats (which depends on the particular gene and disease). The newly synthesized ssDNA strand comprising the healthy triplet repeat sequence also is synthesized to include a short stretch of homology (i.e., the homology arm) that matches the sequence adjacent to the other end of the repeat (red strand). Invasion of the newly synthesized strand, and subsequent replacement of the endogenous DNA with the newly synthesized ssDNA flap, leads to a contracted repeat allele.

Depending on the particular trinucleotide repeat expansion disorder, the defect-inducing triplet expansions may occur in "trinucleotide repeat expansion proteins." Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders can be selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non-limiting examples of proteins associated with trinucleotide repeat expansion disorders which can be corrected by prime editing include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN8OS (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L1 (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3

(canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L14), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C10orf2 (chromosome 10 open reading frame 2), MAML3 mastermind-like 3 (*Drosophila*), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SP1 (Sp1 transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDA1 (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox A1), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

In a particular aspect, the instant disclosure provides TPRT-based methods for the treatment of a subject diagnosed with an expansion repeat disorder (also known as a repeat expansion disorder or a trinucleotide repeat disorder). Expansion repeat disorders occur when microsatellite repeats expand beyond a threshold length. Currently, at least 30 genetic diseases are believed to be caused by repeat expansions. Scientific understanding of this diverse group of disorders came to lights in the early 1990's with the discovery that trinucleotide repeats underlie several major inherited conditions, including Fragile X, Spinal and Bulbar Muscular Atrophy, Myotonic Dystrophy, and Huntington's disease (Nelson et al, "The unstable repeats—three evolving faces of neurological disease," *Neuron*, Mar. 6, 2013, Vol. 77; 825-843, which is incorporated herein by reference), as well as Haw River Syndrome, Jacobsen Syndrome, Dentatorubral-pallidoluysian atrophy (DRPLA), Machado-Joseph disease, Synpolydactyly (SPD II), Hand-foot genital syndrome (HFGS), Cleidocranial dysplasia (CCD), Holoprosencephaly disorder (HPE), Congenital central hypventilation syndrome (CCHS), ARX-nonsyndromic X-linked mental retardation (XLMR), and Oculopharyngeal muscular dystrophy (OPMD) (see. Microsatellite repeat instability was found to be a hallmark of these conditions, as was anticipation—the phenomenon in which repeat expansion can occur with each successive generation, which leads to a more severe phenotype and earlier age of onset in the offspring. Repeat expansions are believed to cause diseases via several different mechanisms. Namely, expansions may interfere with cellular functioning at the level of the gene, the mRNA transcript, and/or the encoded protein. In some conditions, mutations act via a loss-of-function mechanism by silencing repeat-containing genes. In others, disease results from gain-of-function mechanisms, whereby either the mRNA transcript or protein takes on new, aberrant functions.

In one embodiment, a method of treating a trinucleotide repeat disorder is depicted in FIG. 23. In general, the approach involves using TPRT genome editing (i.e., prime editing) in combination with an extended gRNA that comprises a region that encodes a desired and healthy replacement trinucleotide repeat sequence that is intended to replace the endogenous diseased trinucleotide repeat sequence through the mechanism of the prime editing process. A schematic of an exemplary gRNA design for contracting trinucleotide repeat sequences and trinucleotide repeat contraction with TPRT genome editing (i.e., prime editing) is shown in FIG. 23.

Prion Disease

Prime editing can also be used to prevent or halt the progression of prion disease through the installation of one or more protective mutations into prion proteins (PRNP) which become misfolded during the course of disease. Prion diseases or transmissible spongiform encephalopathies (TSEs) are a family of rare progressive neurodegenerative disorders that affect both humans and animals. They are distinguished by long incubation periods, characteristic spongiform changes associated with neuronal loss, and a failure to induce inflammatory response.

In humans, prion disease includes Creutzfeldt-Jakob Disease (CJD), Variant Creutzfeldt-Jakob Disease (vCJD), Gerstmann-Straussler-Scheinker Syndrome, Fatal Familial Insomnia, and Kuru. In animals, prion disease includes Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy. Prime editing may be used to install protective point mutations into a prion protein in order to prevent or halt the progression of any one of these prion diseases.

Classic CJD is a human prion disease. It is a neurodegenerative disorder with characteristic clinical and diagnostic features. This disease is rapidly progressive and always fatal. Infection with this disease leads to death usually within 1 year of onset of illness. CJD is a rapidly progressive, invariably fatal neurodegenerative disorder believed to be caused by an abnormal isoform of a cellular glycoprotein known as the prion protein. CJD occurs worldwide and the estimated annual incidence in many countries, including the United States, has been reported to be about one case per million population. The vast majority of CJD patients usually die within 1 year of illness onset. CJD is classified as a transmissible spongiform encephalopathy (TSE) along with other prion diseases that occur in humans and animals. In about 85% of patients, CJD occurs as a sporadic disease with no recognizable pattern of transmission. A smaller proportion of patients (5 to 15%) develop CJD because of inherited mutations of the prion protein gene. These inherited forms include Gerstmann-Straussler-Scheinker syndrome and fatal familial insomnia. No treatment is currently known for CJD.

Variant Creutzfeldt-Jakob disease (vCJD) is a prion disease that was first described in 1996 in the United Kingdom. There is now strong scientific evidence that the agent responsible for the outbreak of prion disease in cows, bovine spongiform encephalopathy (BSE or 'mad cow' disease), is the same agent responsible for the outbreak of vCJD in humans. Variant CJD (vCJD) is not the same disease as classic CJD (often simply called CJD). It has different clinical and pathologic characteristics from classic CJD. Each disease also has a particular genetic profile of the prion protein gene. Both disorders are invariably fatal brain diseases with unusually long incubation periods measured in years and are caused by an unconventional transmissible agent called a prion. No treatment is currently known for vCJD.

BSE (bovine spongiform encephalopathy or "mad cow disease") is a progressive neurological disorder of cattle that results from infection by an unusual transmissible agent called a prion. The nature of the transmissible agent is not well understood. Currently, the most accepted theory is that the agent is a modified form of a normal protein known as prion protein. For reasons that are not yet understood, the normal prion protein changes into a pathogenic (harmful) form that then damages the central nervous system of cattle. There is increasing evidence that there are different strains of BSE: the typical or classic BSE strain responsible for the outbreak in the United Kingdom and two atypical strains (H and L strains). No treatment is currently known for BSE.

Chronic wasting disease (CWD) is a prion disease that affects deer, elk, reindeer, sika deer and moose. It has been found in some areas of North America, including Canada and the United States, Norway and South Korea. It may take over a year before an infected animal develops symptoms, which can include drastic weight loss (wasting), stumbling, listlessness and other neurologic symptoms. CWD can affect animals of all ages and some infected animals may die without ever developing the disease. CWD is fatal to animals and there are no treatments or vaccines.

The causative agents of TSEs are believed to be prions. The term "prions" refers to abnormal, pathogenic agents that are transmissible and are able to induce abnormal folding of specific normal cellular proteins called prion proteins that are found most abundantly in the brain. The functions of these normal prion proteins are still not completely understood. The abnormal folding of the prion proteins leads to brain damage and the characteristic signs and symptoms of the disease. Prion diseases are usually rapidly progressive and always fatal.

As used herein, the term "prion" shall mean an infectious particle known to cause diseases (spongiform encephalopathies) in humans and animals. The term "prion" is a contraction of the words "protein" and "infection" and the particles are comprised largely if not exclusively of PRNP$^{Sc}$ molecules encoded by a PRNP gene which expresses PRNP$^{C}$ which changes conformation to become PRNP$^{Sc}$. Prions are distinct from bacteria, viruses and viroids. Known prions include those which infect animals to cause scrapie, a transmissible, degenerative disease of the nervous system of sheep and goats as well as bovine spongiform encephalopathies (BSE) or mad cow disease and feline spongiform encephalopathies of cats. Four prion diseases, as discussed above, known to affect humans are (1) kuru, (2) Creutzfeldt-Jakob Disease (CJD), (3) Gerstmann-Strassler-Scheinker Disease (GSS), and (4) fatal familial insomnia (FFI). As used herein prion includes all forms of prions causing all or any of these diseases or others in any animals used—and in particular in humans and in domesticated farm animals.

In general, and without wishing to be bound by theory, prior diseases are caused by misfolding of prion proteins. Such diseases—often called deposition diseases—the misfolding of the prion proteins can be accounted for as follows. If A is the normally synthesized gene product that carries out an intended physiologic role in a monomeric or oligomeric state, A* is a conformationally activated form of A that is competent to undergo a dramatic conformational change, B is the conformationally altered state that prefers multimeric assemblies (i.e., the misfolded form which forms depositions) and $B_n$ is the multimeric material that is pathogenic and relatively difficult to recycle. For the prion diseases, PRNP$^{C}$ and PRNP$^{Sc}$ correspond to states A and $B_n$, where A is largely helical and monomeric and $B_n$ is β-rich and multimeric.

It is known that certain mutations in prion proteins can be associated with increased risk of prior disease. Conversely, certain mutations in prion proteins can be protective in nature. See Bagynszky et al., "Characterization of mutations in PRNP (prion) gene and their possible roles in neurodegenerative diseases," *Neuropsychiatr Dis Treat.*, 2018; 14: 2067-2085, the contents of which are incorporated herein by reference.

PRNP (NCBI RefSeq No. NP_000302.1 (SEQ ID NO: 291))—the human prion protein—is encoded by a 16 kb long gene, located on chromosome 20 (4686151-4701588). It contains two exons, and the exon 2 carries the open reading frame which encodes the 253 amino acid (AA) long PrP protein. Exon 1 is a noncoding exon, which may serve as transcriptional initiation site. The post-translational modifications result in the removal of the first 22 AA N-terminal fragment (NTF) and the last 23 AA C-terminal fragment (CTF). The NTF is cleaved after PrP transport to the endoplasmic reticulum (ER), while the CTF (glycosylphosphatidylinositol [GPI] signal peptide [GPI-SP]) is cleaved by the GPI anchor. GPI anchor could be involved in PrP protein transport. It may also play a role of attachment of prion protein into the outer surface of cell membrane. Normal PrP is composed of a long N-terminal loop (which contains the octapeptide repeat region), two short β sheets, three a helices, and a C-terminal region (which contains the GPI anchor). Cleavage of PrP results in a 208 AA long glyocoprotein, anchored in the cell membrane.

The 253 amino acid sequence of PRNP (NP_000302.1) is as follows:

(SEQ ID NO: 291)
MANLGCWMLVLFVATWSDLGLCKKRPKPGGWNTGGSRYPGQGSPG
GNRYPPQGGGGWGQPHGGGWGQPHGGGWGQPHGGGWGQPHGGGWG
QGGGTHSQWNKPSKPKTNMKHMAGAAAAGAVVGGLGGYMLGSAMS
RPIIHFGSDYEDRYYRENMHRYPNQVYYRPMDEYSNQNNFVHDCV
NITIKQHTVTTTTKGENFTETDVKMMERVVEQMCITQYERESQAY
YQRGSSMVLFSSPPVILLISFLIFLIVG.

The 253 amino acid sequence of PRNP (NP_000302.1) is encoded by the following nucleotide sequence (NCBI Ref. Seq No. NM_000311.5, *Homo sapiens* prion protein (PRNP), transcript variant 1, mRNA), is as follows:

(SEQ ID NO: 292)
GCGAACCTTGGCTGCTGGATGCTGGTTCTCTTTGTGGCCACATGGAG
TGACCTGGGCCTCTGCAAGAAGCGCCCGAAGCCTGGAGGATGGAACA
CTGGGGGCAGCCGATACCCGGGGCAGGGCAGCCCTGGAGGCAACCGC
TACCCACCTCAGGGCGGTGGTGGCTGGGGGCAGCCTCATGGTGGTGG
CTGGGGGCAGCCTCATGGTGGTGGCTGGGGGCAGCCCCATGGTGGTG
GCTGGGGACAGCCTCATGGTGGTGGCTGGGGTCAAGGAGGTGGCACC
CACAGTCAGTGGAACAAGCCGAGTAAGCCAAAAACCAACATGAAGCA
CATGGCTGGTGCTGCAGCAGCTGGGGCAGTGGTGGGGGGCCTTGGCG
GCTACATGCTGGGAAGTGCCATGAGCAGGCCCATCATACATTTCGGC
AGTGACTATGAGGACCGTTACTATCGTGAAAACATGCACCGTTACCC
CAACCAAGTGTACTACAGGCCCATGGATGAGTACAGCAACCAGAACA
ACTTTGTGCACGACTGCGTCAATATCACAATCAAGCAGCACACGGTC
ACCACAACCACCAAGGGGGAGAACTTCACCGAGACCGACGTTAAGAT
GATGGAGCGCGTGGTTGAGCAGATGTGTATCACCCAGTACGAGAGGG
AATCTCAGGCCTATTACCAGAGAGGATCGAGCATGGTCCTCTTCTCC
TCTCCACCTGTGATCCTCCTGATCTCTTTCCTCATCTTCCTGATAGT
GGGATGAGGAAGGTCTTCCTGTTTTCACCATCTTTCTAATCTTTTTC
CAGCTTGAGGGAGGCGGTATCCACCTGCAGCCCTTTTAGTGGTGGTG
TCTCACTCTTTCTTCTCTTTGTCCCGGATAGGCTAATCAATACCC
TTGGCACTGATGGGCACTGGAAAACATAGAGTAGACCTGAGATGCTG

-continued
GTCAAGCCCCCTTTGATTGAGTTCATCATGAGCCGTTGCTAATGCCA
GGCCAGTAAAAGTATAACAGCAAATAACCATTGGTTAATCTGGACTT
ATTTTTGGACTTAGTGCAACAGGTTGAGGCTAAAACAAATCTCAGAA
CAGTCTGAAATACCTTTGCCTGGATACCTCTGGCTCCTTCAGCAGCT
AGAGCTCAGTATACTAATGCCCTATCTTAGTAGAGATTTCATAGCTA
TTTAGAGATATTTTCCATTTTAAGAAAACCCGACAACATTTCTGCCA
GGTTTGTTAGGAGGCCACATGATACTTATTCAAAAAAATCCTAGAGA
TTCTTAGCTCTTGGGATGCAGGCTCAGCCCGCTGGAGCATGAGCTCT
GTGTGTACCGAGAACTGGGGTGATGTTTTACTTTTCACAGTATGGGC
TACACAGCAGCTGTTCAACAAGAGTAAATATTGTCACAACACTGAAC
CTCTGGCTAGAGGACATATTCACAGTGAACATAACTGTAACATATAT
GAAAGGCTTCTGGGACTTGAAATCAAATGTTTGGGAATGGTGCCCTT
GGAGGCAACCTCCCATTTTAGATGTTTAAAGGACCCTATATGTGGCA
TTCCTTTCTTTAAACTATAGGTAATTAAGGCAGCTGAAAAGTAAATT
GCCTTCTAGACACTGAAGGCAAATCTCCTTTGTCCATTTACCTGGAA
ACCAGAATGATTTTGACATACAGGAGAGCTGCAGTTGTGAAAGCACC
ATCATCATAGAGGATGATGTAATTAAAAAATGGTCAGTGTGCAAAGA
AAAGAACTGCTTGCATTTCTTTATTTCTGTCTCATAATTGTCAAAAA
CCAGAATTAGGTCAAGTTCATAGTTTCTGTAATTGGCTTTTGAATCA
AAGAATAGGGAGACAATCTAAAAAATATCTTAGGTTGGAGATGACAG
AAATATGATTGATTTGAAGTGGAAAAAGAAATTCTGTTAATGTTAAT
TAAAGTAAAATTATTCCCTGAATTGTTTGATATTGTCACCTAGCAGA
TATGTATTACTTTTCTGCAATGTTATTATTGGCTTGCACTTTGTGAG
TATTCTATGTAAAAATATATATGTATATAAAATATATATTGCATAGG
ACAGACTTAGGAGTTTTGTTTAGAGCAGTTAACATCTGAAGTGTCTA
ATGCATTAACTTTTGTAAGGTACTGAATACTTAATATGTGGGAAACC
CTTTTGCGTGGTCCTTAGGCTTACAATGTGCACTGAATCGTTTCATG
TAAGAATCCAAAGTGGACACCATTAACAGGTCTTTGAAATATGCATG
TACTTTATATTTTCTATATTTGTAACTTTGCATGTTCTTGTTTTGTT
ATATAAAAAATTGTAAATGTTTAATATCTGACTGAAATTAAACGAG
CGAAGATGAGCACCA Mutation sites relative to PRNP (NP_000302.1) which are linked to CJD and FFI are reported are as follows. These mutations can be removed or installed using the prime editors disclosed herein.

|

| MUTATION | AMINO ACID SEQUENCE OF MUTANT PRNP LINKED TO CJD PRION DISEASE (SEE TABLE 1 OF BAGYNSZKY ET AL., 2018) (RELATIVE TO SEQ ID NO: 291 OF PRNP NP_000302.1) |
|---|---|
| T188K | (SEQ ID NO: 3941)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHKVT<br>TTTKGENFTETDVKMMERVVEQMCITQYERESQAYYQRGSSMVLFSSPPV |
| E196K | (SEQ ID NO: 3942)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGKNFTETDVKMMERVVEQMCITQYERESQAYYQRGSSMVLFSSPPV |
| E196A | (SEQ ID NO: 296)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGANFTETDVKMMERVVEQMCITQYERESQAYYQRGSSMVLFSSPPV |
| E200K | (SEQ ID NO: 3943)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHS QWNKPS KPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTKTDVKMMERVVEQMCITQYERESQAYYQRGSSMVLFSSPPV |
| E200G | (SEQ ID NO: 298)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTGTDVKMMERVVEQMCITQYERESQAYYQRGSSMVLFSSPPV |
| V203I | (SEQ ID NO: 3944)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDIKMMERVVEQMCITQYERESQAYYQRGSSMVLFSSPPV |
| R208H | (SEQ ID NO: 3945)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMEHVVEQMCITQYERESQAYYQRGSSMVLFSSPPV |
| V210I | (SEQ ID NO: 3946)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVIEQMCITQYERESQAYYQRGSSMVLFSSPPV |
| E211Q | (SEQ ID NO: 3947)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVQQMCITQYERESQAYYQRGSSMVLFSSPPV |
| M232R | (SEQ ID NO: 3948)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSRVLFSSPPV |

Mutation sites relative to PRNP (NP_000302.1) (SEQ ID NO: 291) which are linked to GSS are reported, as follows:

| MUTATION (RELATIVE TO SEQ ID NO: 291 OF PRNP NP_000302.1) | AMINO ACID SEQUENCE OF MUTANT PRNP LINKED TO GSS PRION DISEASE (SEE TABLE 2 OF BAGYNSZKY ET AL., 2018) |
|---|---|
| P102L | (SEQ ID NO: 3949)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKLSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSMVLFSSPPV |
| P105L | (SEQ ID NO: 3950)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKLKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSMVLFSSPPV |
| A117V | (SEQ ID NO: 3951)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAVAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSMVLFSSPPV |
| G131V | (SEQ ID NO: 3952)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLVSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSMVLFSSPPV |
| V176G | (SEQ ID NO: 3953)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFGHDCVNITIKQHTVT<br>TTTKGENFTETDVKMMERVVEQMCITQYERESQAYYQRGSSMVLFSSPPV |
| H187R | (SEQ ID NO: 3954)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQRTVT<br>TTTKGENFTETDVKMMERVVEQMCITQYERESQAYYQRGSSMVLFSSPPV |
|  | (SEQ ID NO: 487)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSMVLFSSPPV |
| F198S | (SEQ ID NO: 3955)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENSTETDVKMMERVVEQMCITQYERESQAYYQRGSSMVLFSSPPV |
| D202N | (SEQ ID NO: 3956)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETNVKMMERVVEQMCITQYERESQAYYQRGSSMVLFSSPPV |
| Q212P | (SEQ ID NO: 3957)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEPMCITQYERESQAYYQRGSSMVLFSSPPV |
| Q217R | (SEQ ID NO: 3958)<br>MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF |

| MUTATION | AMINO ACID SEQUENCE OF MUTANT PRNP LINKED TO GSS PRION DISEASE (SEE TABLE 2 OF BAGYNSZKY ET AL., 2018) (RELATIVE TO SEQ ID NO: 291 OF PRNP NP_000302.1) |
|---|---|
| | GSDYEDRYYRENMHRYPNQVYYRPMDEYSNQNNFVHDCVNITIKQHTVT<br>TTTKGENFTETDVKMMERVVEQMCITRYERESQAYYQRGSSMVLFSSPPV |
| | (SEQ ID NO: 3959) |
| M232T | MANLGCWMLVLFVATWSDLGLCKKRPKPGGWNTGGSRYPGQGSPGGNR<br>YPPQGGGWGQPHGGGWGQPHGGGWGQPHGGGWGQPHGGGWGQGG<br>GTHSQWNKPSKPKTNMKHMAGAAAAGAVVGGLGGYMLGSAMSRPIIHF<br>GSDYEDRYYRENMHRYPNQVYYRPMDEYSNQNNFVHDCVNITIKQHTVT<br>TTTKGENFTETDVKMMERVVEQMCITQYERESQAYYQRGSSTVLFSSPPV |

Mutation sites relative to PRNP (NP_000302.1) (SEQ ID NO

| MUTATION | AMINO ACID SEQUENCE OF MUTANT PRNP LINKED TO A PROTECTIVE NATURE AGAINST PRION DISEASE (SEE TABLE 4 OF BAGYNSZKY ET AL., 2018) (RELATIVE TO SEQ ID NO: 291 OF PRNP NP_000302.1) |
|---|---|
| | GSDYEDRYYRENMHRYPNQVYYRPMDEYSNQNNFVHDCVNITIKQHTVT TTTKGENFTETDVKMMERVVEQMCITQYERESQAYYQRGSSMVLFSSSPV |

Thus, in various embodiments, prime editing may be used to remove a mutation in PRNP that is linked to prion disease or install a mutation in PRNP that is considered to be protective against prion disease. For example, prime editing may be use to remove or restore a D178N, V180I, T188K, E196K, E196A, E200K, E200G, V203I, R208H, V210I, E211Q, I215V, or M232R mutation in the PRNP protein (relative to PRNP of NP_000302.1) (SEQ ID NO: 291). In other embodiments, prime editing may be use to remove or restore a P102L, P105L, A117V, G131V, V176G, H187R, F198S, D202N, Q212P, Q217R, or M232T mutation in the PRNP protein (relative to PRNP of NP_000302.1) (SEQ ID NO: 291). By removing or correcting for the presence of such mutations in PRNP using prime editing, the risk of prion disease may be reduced or eliminated.

In other embodiments, prime editing may be used to install a protective mutation in PRNP that is linked to a protective effect against one or more prion diseases. For example, prime editing may be used to install a G127S, G127V, M129V, D167G, D167N, N171S, E219K, or P238S protective mutation in PRNP (relative to PRNP of NP_000302.1) (SEQ ID NO: 291). In still other embodiments, the protective mutation may be any alternate amino acid installed at G127, G127, M129, D167, D167, N171, E219, or P238 in PRNP (relative to PRNP of NP_000302.1) (SEQ ID NO: 291).

In particular embodiments, prime editing may be used to install a G127V protective mutation in PRNP, as illustrated in FIG. 27 and discussed in Example 5.

In another embodiment, prime editing may be used to install an E219K protective mutation in PRNP.

The PRNP protein and the protective mutation site are conserved in mammals, so in addition to treating human disease it could also be used to generate cows and sheep that are immune to prion disease, or even help cure wild populations of animals that are suffering from prion disease. Prime editing has already been used to achieve ~25% installation of a naturally occurring protective allele in human cells, and previous mouse experiments indicate that this level of installation is sufficient to cause immunity from most prion diseases. This method is the first and potentially only current way to install this allele with such high efficiency in most cell types. Another possible strategy for treatment is to use prime editing to reduce or eliminate the expression of PRNP by installing an early stop codon in the gene.

Using the principles described herein for PEgRNA design, appropriate PEgRNAs may be designed for installing desired protective mutations, or for removing prion disease-associated mutations from PRNP. For example, the below list of PEgRNAs can be used to install the G127V protective allele and the E219K protective allele in human PRNP, as well as the G127V protective allele in PRNP of various animals.

[9] Pharmaceutical Compositions

Other aspects of the present disclosure relate to pharmaceutical compositions comprising any of the various components of the prime editing system described herein (e.g., including, but not limited to, the napDNAbps, reverse transcriptases, fusion proteins (e.g., comprising napDNAbps and reverse transcriptases), extended guide RNAs, and complexes comprising fusion proteins and extended guide RNAs, as well as accessory elements, such as second strand nicking components and 5' endogenous DNA flap removal endonucleases for helping to drive the prime editing process towards the edited product formation).

The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105). Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2,3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierce-able by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

[10] Kits, Cells, Vectors, and Delivery

Kits

The compositions of the present disclosure may be assembled into kits. In some embodiments, the kit comprises nucleic acid vectors for the expression of the prime editors described herein. In other embodiments, the kit further comprises appropriate guide nucleotide sequences (e.g., PEgRNAs and second-site gRNAs) or nucleic acid vectors for the expression of such guide nucleotide sequences, to target the Cas9 protein or prime editor to the desired target sequence.

The kit described herein may include one or more containers housing components for performing the methods described herein and optionally instructions for use. Any of the kit described herein may further comprise components needed for performing the assay methods. Each component of the kits, where applicable, may be provided in liquid form (e.g., in solution) or in solid form, (e.g., a dry powder). In certain cases, some of the components may be reconstitutable or otherwise processible (e.g., to an active form), for example, by the addition of a suitable solvent or other species (for example, water), which may or may not be provided with the kit.

In some embodiments, the kits may optionally include instructions and/or promotion for use of the components provided. As used herein, "instructions" can define a component of instruction and/or promotion, and typically involve written instructions on or associated with packaging of the disclosure. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use, or sale of pharmaceuticals or biological products, which can also reflect approval by the agency of manufacture, use or sale for animal administration. As used herein, "promoted" includes all methods of doing business including methods of education, hospital and other clinical instruction, scientific inquiry, drug discovery or development, academic research, pharmaceutical industry activity including pharmaceutical sales, and any advertising or other promotional activity including written, oral and electronic communication of any form, associated with the disclosure. Additionally, the kits may include other components depending on the specific application, as described herein.

The kits may contain any one or more of the components described herein in one or more containers. The components may be prepared sterilely, packaged in a syringe and shipped refrigerated. Alternatively it may be housed in a vial or other container for storage. A second container may have other components prepared sterilely. Alternatively the kits may include the active agents premixed and shipped in a vial, tube, or other container.

The kits may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kits may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kits may also include other components, depending on the specific application, for example, containers, cell media, salts, buffers, reagents, syringes, needles, a fabric, such as gauze, for applying or removing a disinfecting agent, disposable gloves, a support for the agents prior to administration, etc. Some aspects of this disclosure provide kits comprising a nucleic acid construct comprising a nucleotide sequence encoding the various components of the prime editing system described herein (e.g., including, but not limited to, the napDNAbps, reverse transcriptases, polymerases, fusion proteins (e.g., comprising napDNAbps and reverse transcriptases (or more broadly, polymerases), extended guide RNAs, and complexes comprising fusion proteins and extended guide RNAs, as well as accessory elements, such as second strand nicking components (e.g., second strand nicking gRNA) and 5' endogenous DNA flap removal endonucleases for helping to drive the prime editing process towards the edited product formation). In some embodiments, the nucleotide sequence(s) comprises a heterologous promoter (or more than a single promoter) that drives expression of the prime editing system components.

Other aspects of this disclosure provide kits comprising one or more nucleic acid constructs encoding the various components of the prime editing system described herein, e.g., the comprising a nucleotide sequence encoding the components of the prime editing system capable of modifying a target DNA sequence. In some embodiments, the nucleotide sequence comprises a heterologous promoter that drives expression of the prime editing system components.

Some aspects of this disclosure provides kits comprising a nucleic acid construct, comprising (a) a nucleotide sequence encoding a napDNAbp (e.g., a Cas9 domain) fused to a reverse transcriptase and (b) a heterologous promoter that drives expression of the sequence of (a).

Cells

Cells that may contain any of the compositions described herein include prokaryotic cells and eukaryotic cells. The methods described herein are used to deliver a Cas9 protein or a prime editor into a eukaryotic cell (e.g., a mammalian cell, such as a human cell). In some embodiments, the cell is in vitro (e.g., cultured cell. In some embodiments, the cell is in vivo (e.g., in a subject such as a human subject). In some embodiments, the cell is ex vivo (e.g., isolated from a subject and may be administered back to the same or a different subject).

Mammalian cells of the present disclosure include human cells, primate cells (e.g., vero cells), rat cells (e.g., GH3 cells, 0C23 cells) or mouse cells (e.g., MC3T3 cells). There are a variety of human cell lines, including, without limitation, human embryonic kidney (HEK) cells, HeLa cells, cancer cells from the National Cancer Institute's 60 cancer cell lines (NCI60), DU145 (prostate cancer) cells, Lncap (prostate cancer) cells, MCF-7 (breast cancer) cells, MDA-MB-438 (breast cancer) cells, PC3 (prostate cancer) cells, T47D (breast cancer) cells, THP-1 (acute myeloid leukemia) cells, U87 (glioblastoma) cells, SHSY5Y human neuroblastoma cells (cloned from a myeloma) and Saos-2 (bone cancer) cells. In some embodiments, rAAV vectors are delivered into human embryonic kidney (HEK) cells (e.g., HEK 293 or HEK 293T cells). In some embodiments, rAAV vectors are delivered into stem cells (e.g., human stem cells) such as, for example, pluripotent stem cells (e.g., human pluripotent stem cells including human induced pluripotent stem cells (hiPSCs)). A stem cell refers to a cell with the ability to divide for indefinite periods in culture and to give rise to specialized cells. A pluripotent stem cell refers to a type of stem cell that is capable of differentiating into all tissues of an organism, but not alone capable of sustaining full organismal development. A human induced pluripotent stem cell refers to a somatic (e.g., mature or adult) cell that has been reprogrammed to an embryonic stem cell-like state by being forced to express genes and factors important for maintaining the defining properties of embryonic stem cells (see, e.g., Takahashi and Yamanaka, *Cell* 126 (4): 663-76, 2006, incorporated by reference herein). Human induced pluripotent stem cell cells express stem cell markers and are capable of generating cells characteristic of all three germ layers (ectoderm, endoderm, mesoderm).

Additional non-limiting examples of cell lines that may be used in accordance with the present disclosure include 293-T, 293-T, 3T3, 4T1, 721, 9L, A-549, A172, A20, A253, A2780, A2780ADR, A2780cis, A431, ALC, B16, B35, BCP-1, BEAS-2B, bEnd.3, BHK-21, BR 293, BxPC3, C2C12, C3H-10T1/2, C6, C6/36, Cal-27, CGR8, CHO, CML T1, CMT, COR-L23, COR-L23/5010, COR-L23/CPR, COR-L23/R23, COS-7, COV-434, CT26, D17, DH82, DU145, DuCaP, E14Tg2a, EL4, EM2, EM3, EMT6/AR1, EMT6/AR10.0, FM3, H1299, H69, HB54, HB55, HCA2, Hepa1c1c7, High Five cells, HL-60, HMEC, HT-29, HUVEC, J558L cells, Jurkat, JY cells, K562 cells, KCL22, KG1, Ku812, KYO1, LNCap, Ma-Mel 1, 2, 3 . . . 48, MC-38, MCF-10A, MCF-7, MDA-MB-231, MDA-MB-435, MDA-MB-468, MDCK II, MG63, MONO-MAC 6, MOR/0.2R, MRC5, MTD-1A, MyEnd, NALM-1, NCI-H69/CPR, NCI-H69/LX10, NCI-H69/LX20, NCI-H69/LX4, NIH-3T3, NW-145, OPCN/OPCT Peer, PNT-1A/PNT 2, PTK2, Raji, RBL cells, RenCa, RIN-5F, RMA/RMAS, S2, Saos-2 cells, Sf21, Sf9, SiHa, SKBR3, SKOV-3, T-47D, T2, T84, THP1, U373, U87, U937, VCaP, WM39, WT-49, X63, YAC-1 and YAR cells.

Some aspects of this disclosure provide cells comprising any of the constructs disclosed herein. In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A 172, A20, A253, A431, A-549, ALC, B16, B35, BCP-1 cells, BEAS-2B, bEnd.3, BHK-21, BR 293. BxPC3. C3H-10T1/2, C6/36, Cal-27, CHO, CHO-7, CHO-IR, CHO-K1, CHO-K2, CHO-T, CHO Dhfr –/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK 11, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof.

Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

Vectors

Some aspects of the present disclosure relate to using recombinant virus vectors (e.g., adeno-associated virus vectors, adenovirus vectors, or herpes simplex virus vectors) for the delivery of the prime editors or components thereof described herein, e.g., the split Cas9 protein or a split nucleobase prime editors, into a cell. In the case of a split-PE approach, the N-terminal portion of a PE fusion protein and the C-terminal portion of a PE fusion are delivered by separate recombinant virus vectors (e.g., adeno-associated virus vectors, adenovirus vectors, or herpes simplex virus vectors) into the same cell, since the full-length Cas9 protein or prime editors exceeds the packaging limit of various virus vectors, e.g., rAAV (~4.9 kb).

Thus, in one embodiment, the disclosure contemplates vectors capable of delivering split prime editor fusion proteins, or split components thereof. In some embodiments, a composition for delivering the split Cas9 protein or split prime editor into a cell (e.g., a mammalian cell, a human cell) is provided. In some embodiments, the composition of the present disclosure comprises: (i) a first recombinant adeno-associated virus (rAAV) particle comprising a first nucleotide sequence encoding a N-terminal portion of a Cas9 protein or prime editor fused at its C-terminus to an intein-N; and (ii) a second recombinant adeno-associated virus (rAAV) particle comprising a second nucleotide sequence encoding an intein-C fused to the N-terminus of a C-terminal portion of the Cas9 protein or prime editor. The rAAV particles of the present disclosure comprise a rAAV vector (i.e., a recombinant genome of the rAAV) encapsidated in the viral capsid proteins.

In some embodiments, the rAAV vector comprises: (1) a heterologous nucleic acid region comprising the first or second nucleotide sequence encoding the N-terminal portion or C-terminal portion of a split Cas9 protein or a split prime editor in any form as described herein, (2) one or more nucleotide sequences comprising a sequence that facilitates expression of the heterologous nucleic acid region (e.g., a promoter), and (3) one or more nucleic acid regions comprising a sequence that facilitate integration of the heterologous nucleic acid region (optionally with the one or more nucleic acid regions comprising a sequence that facilitates expression) into the genome of a cell. In some embodiments, viral sequences that facilitate integration comprise Inverted Terminal Repeat (ITR) sequences. In some embodiments, the first or second nucleotide sequence encoding the N-terminal portion or C-terminal portion of a split Cas9 protein or a split prime editor is flanked on each side by an ITR sequence. In some embodiments, the nucleic acid vector further comprises a region encoding an AAV Rep protein as described herein, either contained within the region flanked by ITRs or outside the region. The ITR sequences can be derived from any AAV serotype (e.g., 1, 2, 3, 4, 5, 6, 7, 8, 9, or 10) or can be derived from more than one serotype. In some embodiments, the ITR sequences are derived from AAV2 or AAV6.

Thus, in some embodiments, the rAAV particles disclosed herein comprise at least one rAAV2 particle, rAAV6 particle, rAAV8 particle, rPHP.B particle, rPHP.eB particle, or rAAV9 particle, or a variant thereof. In particular embodiments, the disclosed rAAV particles are rPHP.B particles, rPHP.eB particles, rAAV9 particles.

ITR sequences and plasmids containing ITR sequences are known in the art and commercially available (see, e.g., products and services available from Vector Biolabs, Philadelphia, Pa.; Cellbiolabs, San Diego, Calif.; Agilent Technologies, Santa Clara, Ca; and Addgene, Cambridge, Mass.; and Gene delivery to skeletal muscle results in sustained expression and systemic delivery of a therapeutic protein. Kessler P D, Podsakoff G M, Chen X, McQuiston S A, Colosi P C, Matelis L A, Kurtzman G J, Byrne B J. *Proc Natl Acad Sci USA*. 1996 Nov. 26; 93(24):14082-7; and Curtis A. Machida. Methods in Molecular Medicine™. Viral Vectors for Gene Therapy Methods and Protocols. 10.1385/1-59259-304-6:201 © Humana Press Inc. 2003. Chapter 10. Targeted Integration by Adeno-Associated Virus. Matthew D. Weitzman, Samuel M. Young Jr., Toni Cathomen and Richard Jude Samulski; U.S. Pat. Nos. 5,139,941 and 5,962,313, all of which are incorporated herein by reference).

In some embodiments, the rAAV vector of the present disclosure comprises one or more regulatory elements to control the expression of the heterologous nucleic acid region (e.g., promoters, transcriptional terminators, and/or other regulatory elements). In some embodiments, the first and/or second nucleotide sequence is operably linked to one or more (e.g., 1, 2, 3, 4, 5, or more) transcriptional terminators. Non-limiting examples of transcriptional terminators that may be used in accordance with the present disclosure include transcription terminators of the bovine growth hormone gene (bGH), human growth hormone gene (hGH), SV40, CW3, φ, or combinations thereof. The efficiencies of several transcriptional terminators have been tested to determine their respective effects in the expression level of the split Cas9 protein or the split prime editor. In some embodiments, the transcriptional terminator used in the present disclosure is a bGH transcriptional terminator. In some embodiments, the rAAV vector further comprises a Woodchuck Hepatitis Virus Posttranscriptional Regulatory Element (WPRE). In certain embodiments, the WPRE is a truncated WPRE sequence, such as "W3." In some embodiments, the WPRE is inserted 5' of the transcriptional terminator. Such sequences, when transcribed, create a tertiary structure which enhances expression, in particular, from viral vectors.

In some embodiments, the vectors used herein may encode the PE fusion proteins, or any of the components thereof (e.g., napDNAbp, linkers, or polymerases). In addition, the vectors used herein may encode the PEgRNAs, and/or the accessory gRNA for second strand nicking. The vectors may be capable of driving expression of one or more coding sequences in a cell. In some embodiments, the cell may be a prokaryotic cell, such as, e.g., a bacterial cell. In some embodiments, the cell may be a eukaryotic cell, such as, e.g., a yeast, plant, insect, or mammalian cell. In some embodiments, the eukaryotic cell may be a mammalian cell. In some embodiments, the eukaryotic cell may be a rodent cell. In some embodiments, the eukaryotic cell may be a human cell. Suitable promoters to drive expression in different types of cells are known in the art. In some embodiments, the promoter may be wild-type. In other embodiments, the promoter may be modified for more efficient or efficacious expression. In yet other embodiments, the promoter may be truncated yet retain its function. For example, the promoter may have a normal size or a reduced size that is suitable for proper packaging of the vector into a virus.

In some embodiments, the promoters that may be used in the prime editor vectors may be constitutive, inducible, or tissue-specific. In some embodiments, the promoters may be a constitutive promoters. Non-limiting exemplary constitutive promoters include cytomegalovirus immediate early promoter (CMV), simian virus (SV40) promoter, adenovirus major late (MLP) promoter, Rous sarcoma virus (RSV) promoter, mouse mammary tumor virus (MMTV) promoter, phosphoglycerate kinase (PGK) promoter, elongation factor-alpha (EF1a) promoter, ubiquitin promoters, actin promoters, tubulin promoters, immunoglobulin promoters, a functional fragment thereof, or a combination of any of the foregoing. In some embodiments, the promoter may be a CMV promoter. In some embodiments, the promoter may be a truncated CMV promoter. In other embodiments, the promoter may be an EF1a promoter. In some embodiments, the promoter may be an inducible promoter. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech). In some embodiments, the promoter may be a tissue-specific promoter. In some embodiments, the tissue-specific promoter is exclusively or predominantly expressed in liver tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-β promoter, Mb promoter, Nphs1 promoter, OG-2 promoter, SP-B promoter, SYN1 promoter, and WASP promoter.

In some embodiments, the prime editor vectors (e.g., including any vectors encoding the prime editor fusion protein and/or the PEgRNAs, and/or the accessory second strand nicking gRNAs) may comprise inducible promoters to start expression only after it is delivered to a target cell. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech).

In additional embodiments, the prime editor vectors (e.g., including any vectors encoding the prime editor fusion protein and/or the PEgRNAs, and/or the accessory second strand nicking gRNAs) may comprise tissue-specific promoters to start expression only after it is delivered into a specific tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-β promoter, Mb promoter, Nphs1 promoter, OG-2 promoter, SP-B promoter, SYN1 promoter, and WASP promoter.

In some embodiments, the nucleotide sequence encoding the PEgRNA (or any guide RNAs used in connection with prime editing) may be operably linked to at least one transcriptional or translational control sequence. In some embodiments, the nucleotide sequence encoding the guide RNA may be operably linked to at least one promoter. In some embodiments, the promoter may be recognized by RNA polymerase III (Pol III). Non-limiting examples of Pol III promoters include U6, HI and tRNA promoters. In some embodiments, the nucleotide sequence encoding the guide RNA may be operably linked to a mouse or human U6 promoter. In other embodiments, the nucleotide sequence encoding the guide RNA may be operably linked to a mouse or human HI promoter. In some embodiments, the nucleotide sequence encoding the guide RNA may be operably linked to a mouse or human tRNA promoter. In embodiments with more than one guide RNA, the promoters used to drive expression may be the same or different. In some embodiments, the nucleotide encoding the crRNA of the guide RNA and the nucleotide encoding the tracr RNA of the guide RNA may be provided on the same vector. In some embodiments, the nucleotide encoding the crRNA and the nucleotide encoding the tracr RNA may be driven by the same promoter. In some embodiments, the crRNA and tracr RNA may be transcribed into a single transcript. For example, the crRNA and tracr RNA may be processed from the single transcript to form a double-molecule guide RNA. Alternatively, the crRNA and tracr RNA may be transcribed into a single-molecule guide RNA.

In some embodiments, the nucleotide sequence encoding the guide RNA may be located on the same vector comprising the nucleotide sequence encoding the PE fusion protein. In some embodiments, expression of the guide RNA and of the PE fusion protein may be driven by their corresponding promoters. In some embodiments, expression of the guide RNA may be driven by the same promoter that drives expression of the PE fusion protein. In some embodiments, the guide RNA and the PE fusion protein transcript may be contained within a single transcript. For example, the guide RNA may be within an untranslated region (UTR) of the Cas9 protein transcript. In some embodiments, the guide RNA may be within the 5' UTR of the PE fusion protein transcript. In other embodiments, the guide RNA may be within the 3' UTR of the PE fusion protein transcript. In some embodiments, the intracellular half-life of the PE fusion protein transcript may be reduced by containing the guide RNA within its 3' UTR and thereby shortening the length of its 3' UTR. In additional embodiments, the guide RNA may be within an intron of the PE fusion protein transcript. In some embodiments, suitable splice sites may be added at the intron within which the guide RNA is located such that the guide RNA is properly spliced out of the transcript. In some embodiments, expression of the Cas9 protein and the guide RNA in close proximity on the same vector may facilitate more efficient formation of the CRISPR complex.

The prime editor vector system may comprise one vector, or two vectors, or three vectors, or four vectors, or five vector, or more. In some embodiments, the vector system may comprise one single vector, which encodes both the PE fusion protein and PEgRNA. In other embodiments, the vector system may comprise two vectors, wherein one vector encodes the PE fusion protein and the other encodes the PEgRNA. In additional embodiments, the vector system may comprise three vectors, wherein the third vector encodes the second strand nicking gRNA used in the herein methods.

In some embodiments, the composition comprising the rAAV particle (in any form contemplated herein) further comprises a pharmaceutically acceptable carrier. In some embodiments, the composition is formulated in appropriate pharmaceutical vehicles for administration to human or animal subjects.

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

Delivery Methods

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a base editor as described herein in combination with (and optionally complexed with) a guide sequence is delivered to a cell.

Exemplary delivery strategies are described herein elsewhere, which include vector-based strategies, PE ribonucleoprotein complex delivery, and delivery of PE by mRNA methods.

In some embodiments, the method of delivery provided comprises nucleofection, microinjection, biolistics, virosomes, liposomes, immunoliposomes, polycation or lipid: nucleic acid conjugates, naked DNA, artificial virions, and agent-enhanced uptake of DNA.

Exemplary methods of delivery of nucleic acids include lipofection, nucleofection, electoporation, stable genome integration (e.g., piggybac), microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™, Lipofectin™ and SF Cell Line 4D-Nucleofector X Kit™ (Lonza)). Cationic and neutral lipids that are suitable for efficient receptor-recognition lipofection of polynucleotides include those of Feigner, WO 91/17424; WO 91/16024. Delivery may be to cells (e.g. in vitro or ex vivo administration) or target tissues (e.g. in vivo administration). Delivery may be achieved through the use of RNP complexes.

The preparation of lipid:nucleic acid complexes, including targeted liposomes such as immunolipid complexes, is well known to one of skill in the art (see, e.g., Crystal, *Science* 270:404-410 (1995); Blaese et al., *Cancer Gene Ther.* 2:291-297 (1995); Behr et al., *Bioconjugate Chem.* 5:382-389 (1994); Remy et al., *Bioconjugate Chem.* 5:647-654 (1994); Gao et al., *Gene Therapy* 2:710-722 (1995); Ahmad et al., *Cancer Res.* 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

In other embodiments, the method of delivery and vector provided herein is an RNP complex. RNP delivery of fusion proteins markedly increases the DNA specificity of base editing. RNP delivery of fusion proteins leads to decoupling of on- and off-target DNA editing. RNP delivery ablates off-target editing at non-repetitive sites while maintaining on-target editing comparable to plasmid delivery, and greatly reduces off-target DNA editing even at the highly repetitive VEGFA site 2. See Rees, H. A. et al., Improving the DNA specificity and applicability of base editing through protein engineering and protein delivery, *Nat. Commun.* 8, 15790 (2017), U.S. Pat. No. 9,526,784, issued Dec. 27, 2016, and U.S. Pat. No. 9,737,604, issued Aug. 22, 2017, each of which is incorporated by reference herein.

Additional methods for the delivery of nucleic acids to cells are known to those skilled in the art. See, for example, US 2003/0087817, incorporated herein by reference.

Other aspects of the present disclosure provide methods of delivering the prime editor constructs into a cell to form a complete and functional prime editor within a cell. For example, in some embodiments, a cell is contacted with a composition described herein (e.g., compositions comprising nucleotide sequences encoding the split Cas9 or the split prime editor or AAV particles containing nucleic acid vectors comprising such nucleotide sequences). In some embodiments, the contacting results in the delivery of such nucleotide sequences into a cell, wherein the N-terminal portion of the Cas9 protein or the prime editor and the C-terminal portion of the Cas9 protein or the prime editor are expressed in the cell and are joined to form a complete Cas9 protein or a complete prime editor.

It should be appreciated that any rAAV particle, nucleic acid molecule or composition provided herein may be introduced into the cell in any suitable way, either stably or transiently. In some embodiments, the disclosed proteins may be transfected into the cell. In some embodiments, the cell may be transduced or transfected with a nucleic acid molecule. For example, a cell may be transduced (e.g., with a virus encoding a split protein), or transfected (e.g., with a plasmid encoding a split protein) with a nucleic acid molecule that encodes a split protein, or an rAAV particle containing a viral genome encoding one or more nucleic acid molecules. Such transduction may be a stable or transient transduction. In some embodiments, cells expressing a split protein or containing a split protein may be transduced or transfected with one or more guide RNA sequences, for example in delivery of a split Cas9 (e.g., nCas9) protein. In some embodiments, a plasmid expressing a split protein may be introduced into cells through electroporation, transient (e.g., lipofection) and stable genome integration (e.g., piggybac) and viral transduction or other methods known to those of skill in the art.

In certain embodiments, the compositions provided herein comprise a lipid and/or polymer. In certain embodiments, the lipid and/or polymer is cationic. The preparation of such lipid particles is well known. See, e.g. U.S. Pat. Nos. 4,880,635; 4,906,477; 4,911,928; 4,917,951; 4,920,016; 4,921,757; and 9,737,604, each of which is incorporated herein by reference.

The guide RNA sequence may be 15-100 nucleotides in length and comprise a sequence of at least 10, at least 15, or at least 20 contiguous nucleotides that is complementary to a target nucleotide sequence. The guide RNA may comprise a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target nucleotide sequence. The guide RNA may be 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length.

In some embodiments, the target nucleotide sequence is a DNA sequence in a genome, e.g. a eukaryotic genome. In certain embodiments, the target nucleotide sequence is in a mammalian (e.g. a human) genome.

The compositions of this disclosure may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent, i.e., a carrier or vehicle.

Treatment of a disease or disorder includes delaying the development or progression of the disease, or reducing disease severity. Treating the disease does not necessarily require curative results.

As used therein, "delaying" the development of a disease means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset.

As used herein "onset" or "occurrence" of a disease includes initial onset and/or recurrence. Conventional methods, known to those of ordinary skill in the art of medicine, can be used to administer the isolated polypeptide or pharmaceutical composition to the subject, depending upon the type of disease to be treated or the site of the disease.

Without further elaboration, it is believed that one skilled in the art can, based on the above description, utilize the present disclosure to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

Example 1. Prime Editing (PE) for Installing Precise Nucleotide Changes in the Genome The objective is to develop a transformative genome editing technology for precise and general installation of single nucleotide changes in mammalian genomes. This technology would allow investigators to study the effects of single nucleotide variations in virtually any mammalian gene, and potentially enable therapeutic interventions for correcting pathogenic point mutations in human patients.

Adoption of the clustered regularly interspaced short palindromic repeat (CRISPR) system for genome editing has revolutionized the life sciences[1-3]. Although gene disruption using CRISPR is now routine, the precise installation of single nucleotide edits remains a major challenge, despite being necessary for studying or correcting a large number of disease-causative mutations. Homology directed repair (HDR) is capable of achieving such edits, but suffers from low efficiency (often <5%), a requirement for donor DNA repair templates, and deleterious effects of double-stranded DNA break (DSB) formation. Recently, the Liu laboratory developed base editing, which achieves efficient single nucleotide editing without DSBs. Base editors (BEs) combine the CRISPR system with base-modifying deaminase enzymes to convert target C.G or A.T base pairs to A.T or G.C, respectively[46]. Although already widely used by researchers worldwide (>5,000 Liu lab BE constructs distributed by Addgene), current BEs enable only four of the twelve possible base pair conversions and are unable to correct small insertions or deletions. Moreover, the targeting scope of base editing is limited by the editing of non-target C or A bases adjacent to the target base ("bystander editing") and by the requirement that a PAM sequence exist 15±2 bp from the target base. Overcoming these limitations would therefore greatly broaden the basic research and therapeutic applications of genome editing.

Here, it is proposed to develop a new precision editing approach that offers many of the benefits of base editing— namely, avoidance of double strand breaks and donor DNA repair templates—while overcoming its major limitations. To achieve this ambitious goal, it is aimed to directly install edited DNA strands at target genomic sites using target-primed reverse transcription (TPRT). In the design discussed herein, CRISPR guide RNA (gRNA) will be engineered to carry a template encoding mutagenic DNA strand synthesis, to be executed by an associated reverse transcriptase (RT) enzyme. The CRISPR nuclease (Cas9)-nicked target site DNA will serve as the primer for reverse transcription, allowing for direct incorporation of any desired nucleotide edit.

Section 1

Establish guide RNA-templated reverse transcription of mutagenic DNA strands. Prior studies have shown that, following DNA cleavage but prior to complex dissociation, Cas9 releases the non-target DNA strand to expose a free 3' terminus. It is hypothesized that this DNA strand is accessible to extension by polymerase enzymes, and that gRNAs can be engineered through extension of their 5' or 3' terminus to serve as templates for DNA synthesis. In preliminary in vitro studies, it was established that nicked DNA strands within Cas9:gRNA-bound complexes can indeed prime reverse transcription using the bound gRNA as a template (RT enzyme in trans). Next, different gRNA linkers, primer binding sites, and synthesis templates will be explored to determine optimal design rules in vitro. Then, different RT enzymes, acting in trans or as fusions to Cas9, will be evaluated in vitro. Finally, engineered gRNA designs will be identified that retain efficient binding and cutting activity in cells. Successful demonstration of this aim will provide a foundation for carrying out mutagenic strand synthesis in cells.

Section 2

Establish prime editing in human cells. Based on DNA processing and repair mechanisms, it is hypothesized that mutagenic DNA strands (single stranded flaps) can be used to direct specific and efficient editing of target nucleotides. In encouraging preliminary studies, feasibility for this strategy was established by demonstrating editing with model plasmid substrates containing mutagenic flaps. Concurrent with Aim 1, repair outcomes will be further evaluated by systematically varying the mutagenic flap's length, sequence composition, target nucleotide identity, and 3' terminus. Small 1 to 3 nucleotide insertions and deletions will also be tested. In parallel, and building from Aim 1, Cas9-RT architectures will be evaluated, including fusion proteins and non-covalent recruitment strategies. Cas9-RT architectures and extended gRNAs will be assayed for cellular editing at multiple target sites in the human genome, and will then be optimized for high efficiency. If successful, this aim would immediately establish TPRT genome editing (i.e., prime editing) for basic science applications.

Section 3

Achieve site-specific editing of pathogenic mutations in cultured human cells. The potential generality of this technology could enable editing of transversion mutations and indels that are not currently correctable by BEs. Guided by the results of Aim 1 and Aim 2, pathogenic transversion mutations will be targeted in cultured human cells, including the sickle cell disease founder mutation in beta globin (requires an A.T to T.A transversion to correct) and the most prevalent Wilson's disease mutation in ATP7B (requires a G.C to T.A transversion to correct). The correction of small insertion and deletion mutations will also be examined, including the 3-nucleotide AF508 deletion in CFTR that causes cystic fibrosis. If successful, this would lay the foundation for developing powerful therapeutic approaches that address these important human diseases.

Approach

The objective is to develop a genome editing strategy that directly installs point mutations at targeted genomic sites. In the technology development phase, efforts will focus on protein and RNA engineering to incorporate TPRT functionality into the CRISPR/Cas system. In vitro assays will be used to carefully probe the function of each step of TPRT, building from the ground up (Aim 1). The second focus area will evaluate editing outcomes in mammalian cells using a combination of model substrates and engineered CRISPR/Cas systems (Aim 2). Finally, the application phase will use the technology to correct mutations that have been intractable to genome editing by other methods (Aim 3).

The general editing design is shown in FIGS. 1A-1B. Cas9 nickases contain inactivating mutations to the HNH nuclease domain (Spy Cas9 H840A or N863A), restricting DNA cleavage to the PAM containing strand (non-target strand). Guide RNAs (gRNAs) are engineered to contain a template for reverse transcription (designs detailed on slide 5). Shown is a 5' extension of the gRNA, but 3' extensions can also be implemented. The Cas9 nickase is fused to a reverse transcriptase (RT) enzyme, either through the C-terminus or N-terminus. The gRNA:Cas9-RT complex targets the DNA region of interest and forms an R loop after displacing the non-target strand. Cas9 nicks the non-target DNA strand. Release of the nicked strand exposes a free 3'-OH terminus that is competent to prime reverse transcription using the extended gRNA as a template. This DNA synthesis reaction is carried out by the fused RT enzyme. The gRNA template encodes a DNA sequence that is homologous to the original DNA duplex, with the exception of the nucleotide that is targeted for editing. The product of reverse transcription is a single stranded DNA flap that encodes the desired edit. This flap, which contains a free 3' terminus, can equilibrate with the adjacent DNA strand, resulting in a 5' flap species. The latter species is hypothesized to serve as an efficient substrate for FEN1 (flap endonuclease 1), an enzyme that naturally excises 5' flaps from Okazaki fragments during lagging strand DNA synthesis, and removes 5' flaps following strand displacement synthesis that occurs during long-patch base excision repair. Ligation of the nicked DNA produces a mismatched base pair. This intermediate could either undergo reversion to the original base pair or conversion to the desired edited base pair via mismatch repair (MMR) processes. Alternatively, semiconservative DNA replication could give rise to one copy each of the reversion and edit.

1. Establish Guide RNA-Templated Reverse Transcription of Mutagenic DNA Strands.

Background and Rationale

Figure 2:
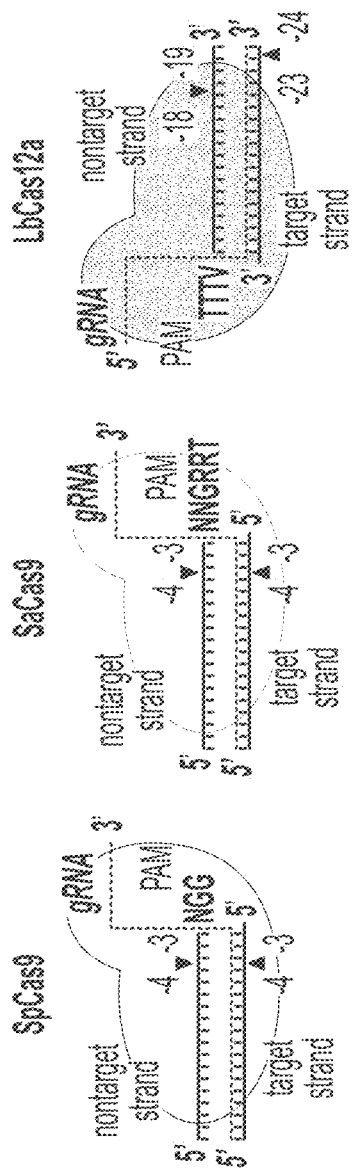

In the proposed genome editing strategy, the Cas9-nicked non-target DNA strand (PAM-containing strand that forms the R-loop) acts as the primer for DNA synthesis. It is hypothesized that this is possible based on several pieces of biochemical and structural data. Nuclease protection experiments[32], crystallographic studies[33], and base editing windows[4,24] have demonstrated a large degree of flexibility and disorder for the non-target strand nucleotides −20 through −10 within the so-called R-loop of the Cas9-bound complex (numbering indicates distance 5' from first PAM nucleotide). Moreover, the PAM-distal portion of the cleaved non-target strand can be displaced from tightly bound ternary complexes when complementary ssDNA is added in trans[20]. These studies support that the non-target strand is highly flexible, is accessible to enzymes, and that after nicking, the 3' terminus of the PAM-distal fragment is released prior to Cas9 dissociation. Furthermore, it is hypothesized that gRNAs can be extended to template DNA synthesis. Prior studies have shown that gRNAs for SpCas9, SaCas9, and LbCas12a (formerly Cpf1) tolerate gRNA extensions with RNA aptamers[34], ligand-inducible self-cleaving ribozymes[35], and long non-coding RNAs[36]. This literature establishes precedent for two major features that will be exploited. In assessing this strategy, several CRISPR-Cas systems will be evaluated in conjunction with 5' and 3' extended gRNA designs using a combination of in vitro and cellular assays (FIGS. 2A-2C).

Designs for engineered gRNAs for TRT editing are shown in FIGS. 3A-3B. DNA synthesis proceeds 5' to 3', and thus copies the RNA template in the 3' to 5' direction. The design for the 5' extension contains a linker region, a primer binding site where the nicked DNA strand anneals, and a template for DNA synthesis by reverse transcription. The 3' extended gRNA contains a primer binding site and a reverse transcription template. In some cases, the 3' RNA hairpin of the gRNA core is modified to match the DNA target sequence, as in vitro experiments showed that reverse transcription extends ~3 nucleotides into the gRNA core for the 3' extended gRNA constructs (modification of the hairpin sequence appears well tolerated so long as compensatory changes are made that maintain the hairpin RNA structure). DNA synthesis proceed 5' to 3', with nucleotides added to the 3' OH of the growing DNA strand.

Preliminary Results

Cas9 nicked DNA primes reverse transcription of gRNA templates. To evaluate the accessibility of the nicked non-target DNA strand, in vitro biochemical assays were performed using the Cas9 nuclease from S. pyogenes (SpCas9) and Cy5 fluorescently labeled duplex DNA substrates (51 base pairs). First, a series of gRNAs containing 5' extensions with varying synthesis template lengths were prepared by in vitro transcription (overall design shown in FIG. 2B). Electrophoretic mobility shift assays (EMSA) with nuclease dead Cas9 (dCas9) established that 5' extended gRNAs maintain target binding affinity (data not shown). Next, TPRT activity was tested on pre-nicked Cy5-labeled duplex DNA substrates using dCas9, 5'-extended gRNAs, and Molony-Murine Leukemia Virus (M-MLV) reverse transcriptase (Superscript III). After 1 hour of incubation at 37° C., products were evaluated by denaturing polyacrylamide gel electrophoresis (PAGE) and imaged using Cy5 fluorescence (FIG. 4A). Each 5'-extended gRNA variant led to significant product formation, with the observed DNA product sizes being consistent with the length of the extension template (FIG. 4B). Importantly, in the absence of dCas9, pre-nicked substrates were extended to the full 51-bp length of the DNA substrate, strongly suggesting that the complementary DNA strand, and not the gRNA, was used as the template for DNA synthesis when dCas9 was not present (FIG. 4C). Of note, the system was designed such that the newly synthesized DNA strand mirrors the product that would be required for target site editing (a homologous strand with a single nucleotide change). This result establishes that Cas9:gRNA binding exposes the nicked non-target strand's 3' end, and that the non-target strand is accessible to reverse transcription.

Next, non-nicked dsDNA substrates were evaluated using the Cas9(H840A) mutant, which nicks the non-target DNA strand. First, to test Cas9(H840A) nickase activity with 5'-extended gRNAs, in vitro cleavage assays were performed as previously described[37]. Although nicking was impaired by comparison to the standard gRNA, appreciable cleavage products were formed (FIG. 4D). Importantly, RT products were also observed when TPRT reactions were carried out with 5'-extended gRNAs and Cas9(H840A), albeit at lower yields that are likely explained by the decreased nicking activity (FIG. 4D). This result establishes that 5'-extended gRNA:Cas9(H840A) complexes can nick DNA and template reverse transcription.

Finally, 3' gRNA extensions were evaluated for Cas9 (H840A) nicking and TPRT. By comparison to 5'-extended gRNAs, DNA cleavage by 3'-extended gRNAs was not impaired to any detectable extent compared to the standard gRNA. Significantly, 3'-extended gRNA templates also supported efficient reverse transcription with both pre-nicked and intact duplex DNA substrates when M-MLV RT was supplied in trans (FIG. 4E). Surprisingly, only a single product was observed for 3'-extended templates, indicating that reverse transcription terminates at a specific location along the gRNA scaffold. Homopolymer tailing of the product with terminal transferase followed by Klenow extension and Sanger sequencing revealed that the full gRNA synthesis template was copied in addition to the terminal 3 nucleotides of the gRNA core. In the future, the flap terminus will be reprogrammed by modifying the terminal gRNA sequence[38,39]. This result demonstrates that 3'-extended gRNAs can serve as efficient nuclease targeting guides and can template reverse transcription.

Cas9-TPRT uses nicked DNA and gRNA in cis. Dual color experiments were used to determine if the RT reaction preferentially occurs with the gRNA in cis (bound in the same complex) (see FIG. 8). Two separate experiments were conducted for 5'-extended and 3'-extended gRNAs. For a given experiment, ternary complexes of dCas9, gRNA, and DNA substrate were formed in separate tubes. In one tube, the gRNA encodes a long RT product and the DNA substrate is labeled with Cy3 (red); in the other, the gRNA encodes a short RT product and the DNA substrate is labeled with Cy5 (blue). After short incubations, the complexes were mixed and then treated with RT enzyme and dNTPs. Products were separated by urea-denaturing PAGE and visualized by fluorescence in the Cy3 and Cy5 channels. Reaction products were found to preferentially form using the gRNA template that was pre-complexed with the DNA substrate, indicating that the RT reaction likely can occur in cis. This results supports that a single Cas9:gRNA complex can target a DNA site and template reverse transcription of a mutagenic DNA strand.

Testing TPRT with Other Cas Systems

Similar experiments to those presented in the previous sections will be carried out using other Cas systems, including Cas9 from *S. aureus* and Cas12a from L. bacterium (see FIGS. 2A-2C). If TRPT can also be demonstrated for these Cas variants, the potential editing scope and likelihood of overall success in cells would increase.

Testing TPRT with RT-Cas9 Fusion Proteins

A series of commercially available or purifiable RT enzymes will first be evaluated in trans for TPRT activity. In addition to the already tested RT from M-MLV, the RT from Avian Myeloblastosis Virus (AMV), the *Geobacillus stearothermophilus* Group II Intron (GsI-IIC)[41,42], and the *Eubacterium rectale* group II intron (Eu.re.I2)[43,44] will be evaluated. Significantly, the latter two RTs perform TPRT in their natural biological contexts. Where relevant, RNAse inactivating mutations and other potentially beneficial RT enzyme modifications will be tested. Once functional RTs are identified when supplied in trans, each will be evaluated as a fusion protein to Cas9 variants. Both N-terminus and C-terminus fusion orientations will be tested, along with various linker lengths and architectures. Kinetic time course experiments will be used to determine whether TPRT can occur using the RT enzyme in cis. If an RT-Cas9 fusion architecture can be constructed that allows for efficient TPRT chemistry, this will greatly increase the likelihood of functional editing in the context of a cell.

Cas9 Targeting with Engineered gRNAs in Cells

Candidate engineered gRNAs developed in the previous sub-aims will be evaluated in human cell culture experiments (HEK293) to confirm Cas9 targeting efficiency. Using established indel formation assays employing wild type SpCas9[45], engineered gRNAs will be compared side-by-side with standard gRNAs across 5 or more sites in the human genome. Genome editing efficiency will be characterized by amplicon sequencing in multiplex using the Illumina MiSeq platform housed in the laboratory. It is anticipated that results from this and the preceding sections will generate insights that inform subsequent iterations of the design-build-test cycle, where gRNAs can be optimized for both templating reverse transcription and efficient Cas9 targeting in cells.

Results of in vitro validations are shown in FIGS. 5-7. In vitro experiments demonstrated that the nicked non-target DNA strand is flexible and available for priming DNA synthesis, and that the gRNA extension can serve as a template for reverse transcription (see FIG. 5). This set of experiments used 5'-extended gRNAs (designed as shown in FIGS. 3A-3B) with varying length synthesis templates (listed to the left). Fluorescently labeled (Cy5) DNA targets were used as substrates, and were pre-nicked in this set of experiments. The Cas9 used in these experiments is catalytically dead Cas9 (dCas9), so cannot cut DNA but can still bind efficiently. Superscript III, a commercial RT derived from the Moloney-Murine Leukemia Virus (M-MLV), was supplied in trans. First, dCas9:gRNA complexes were formed from purified components. Then, the fluorescently labeled DNA substrate was added along with dNTPs and the RT enzyme. After 1 hour of incubation at 37 C, the reaction products were analyzed by denaturing urea-polyacrylamide gel electrophoresis (PAGE). The gel image shows extension of the original DNA strand to lengths that are consistent with the length of the reverse transcription template. Of note, reactions carried out in the absence of dCas9 produced DNA products of length 51 nucleotides, regardless of the gRNA used. This product corresponds to use of the complementary DNA strand as the template for DNA synthesis and not the RNA (data not shown). Thus, Cas9 binding is required for directing DNA synthesis to the RNA template. This set of in vitro experiments closely parallels those shown in FIG. 5, except that the DNA substrate is not pre-nicked, and a Cas9 nickase (SpyCas9 H840A mutant) is used. As shown in the gel, the nickase efficiently cleaves the DNA strand when the standard gRNA is used (gRNA_0, lane 3). Multiple cleavage products are observed, consistent with prior biochemical studies of SpyCas9. The 5' extension impairs nicking activity (lanes 4-8), but some RT product is still observed. FIG. 7 shows that 3' extensions support DNA synthesis and do not significantly effect Cas9 nickase activity. Pre-nicked substrates (black arrow) are near-quantitatively converted to RT products when either dCas9 or Cas9 nickase is used (lanes 4 and 5). Greater than 50% conversion to the RT product (red arrow) is observed with full substrates (lane 3). To determine the length and sequence of the RT product, the product band was excised from the gel, extracted, and sequenced. This revealed that RT extended 3 nucleotides into the gRNA core's 3' terminal hairpin. Subsequent experiments (not shown) demonstrated that these three nucleotides could be changed to match target DNA sequences, so long as complementary changes were made that maintain the hairpin RNA structure.

Potential Difficulties and Alternatives (1) RT does not function as a fusion: molecular crowding and/or unfavorable geometries could encumber polymerase extension by Cas9-fused RT enzymes. First, linker optimization can be tested. Circularly permutated variants of Cas9, which could re-orient the spatial relationship between the DNA primer, gRNA, and RT enzyme, will be evaluated. Non-covalent RT recruitment strategies as detailed in Aim 2 can be tested. (2) Decreased Cas targeting efficiency by extended gRNA variants: this is most likely to be an issue for 5'-extended gRNAs. Based on structural data[24], Cas9 mutants can be designed and screened to identify variants with greater tolerance to gRNA extension. In addition, gRNA libraries could be screened in cells for linkers that improve targeting activity.

Significance

These preliminary results establish that Cas9 nickases and extended gRNAs can initiate target-primed reverse transcription on bound DNA targets using a reverse transcriptase supplied in trans. Importantly, Cas9 binding was found to be critically important for product formation. Though perhaps not an absolute requirement for genome editing in cells, further development of the system that incorporates RT enzyme function in cis would significantly increase the likelihood of success in cell-based applications. Achievement of the remaining aspects of this Aim would provide a molecular foundation for carrying out precision genome editing in the context of the human genome.

2. Establish Prime Editing in Human Cells.

Background and Rationale

In the proposed strategy, an engineered RT-Cas9:gRNA complex will introduce mutagenic 3' DNA flaps at genomic target sites. It is hypothesized that mutagenic 3' flaps containing a single mismatch will be incorporated by the DNA repair machinery through energetically accessible equilibration with adjacent 5' flaps, which would be preferentially removed (FIGS. 1C-1D). The DNA replication and repair machineries encounter 5' ssDNA flaps when processing Okazaki fragments[46] and during long-patch base excision repair (LP-BER)[47]. 5' flaps are the preferred substrates for the widely expressed flap endonuclease FEN1, which is recruited to DNA repair sites by the homotrimeric sliding clamp complex PCNA[48]. PCNA also serves as a scaffold for simultaneous recruitment of other repair factors including the DNA ligase Lig1[49]. Acting as a 'toolbelt', PCNA accelerates serial flap cleavage and ligation, which is essential to processing the millions of Okazaki fragments generated during every cell division[50,51]. Based on resemblance to these natural DNA intermediates, it is hypothesized that mutagenic strands would be incorporated through equilibration with 5' flaps, followed by coordinated 5' flap excision and ligation. Mismatch repair (MMR) should then occur on either strand with equal probability, leading to editing or reversion (FIGS. 1C-1D). Alternatively, DNA replication could occur first and lead directly to the incorporation of the edit in the newly synthesized daughter strand. While the highest expected yield from this process is 50%, multiple substrate editing attempts could drive the reaction toward completion due to the irreversibility of editing repair.

Preliminary Result

DNA flaps induce site-specific mutagenesis in plasmid model substrates in yeast and HEK cells. To test the proposed editing strategy, studies were initiated with model plasmid substrates containing mutagenic 3' flaps that resemble the product of TPRT. A dual fluorescent protein reporter was created that encodes a stop codon between GFP and mCherry. Mutagenic flaps encode a correction to the stop codon (FIG. 9A), enabling mCherry synthesis. Thus, mutagenesis efficiency can be quantified by GFP:mCherry ratios. Plasmid substrates were prepared in vitro and introduced into yeast (S. cerevisiae) or human cells (HEK293). High frequency mutagenesis was observed in both systems (FIG. 9B), and isolated yeast colonies contained either the reverted base, the mutated base, or a mixture of both products (FIG. 9C). Detection of the latter suggests that plasmid replication occurred prior to MMR in these cases, and further suggests that flap excision and ligation precede MMR. This result establishes the feasibility of DNA editing using 3' mutagenic strands.

Systematic Studies with Model Flap Substrates

Based on the preliminary results described above, a broader spectrum of flap substrates will be evaluated in HEK cells to infer principles of efficient editing. 3' ssDNA flaps will be systematically varied to determine the influence of mismatch pairings, the location of the mutagenic nucleotide along the flap, and the identity of the terminal nucleotide (FIG. 9D). Single nucleotide insertions and deletions will also be tested. Amplicon sequencing will be used to analyze editing precision. These results will help inform the design of gRNA reverse transcription templates.

In vitro TPRT on plasmid substrates leads to efficient editing outcomes. TPRT reactions developed in Aim 1 were used to induce mutagenesis within a plasmid substrate. The reaction was carried out on circular DNA plasmid substrates (see FIG. 10). This rules out the possibility of DNA strand dissociation as the mechanism for RT extension in the previous in vitro experiments. It also allowed for the testing of DNA repair of flap substrates in cells. A dual-fluorescent reporter plasmid was constructed for yeast (S. cerevisiae) expression. This plasmid encodes GFP (green fluorescent protein) and mCherry (red fluorescent protein) with an intervening stop codon (TGA). Expression of this construct in yeast produces only GFP. The plasmid was used as a substrate for in vitro TRT [Cas9(H840A) nickase, engineered gRNA, MLV RT enzyme, dNTPS]. The gRNA extension encodes a mutation to the stop codon. The flap strand is used for repair of the stop codon and it is anticipated to produce a plasmid that expresses both GFP and mCherry as a fusion protein. Yeast dual-FP plasmid transformants are shown in FIG. 10. Transforming the parent plasmid or an in vitro Cas9(H840A) nicked plasmid results in only green GFP expressing colonies. TRT reaction with 5'-extended or 3'-extended gRNAs produces a mix of green and yellow colonies. The latter express both GFP and mCherry. More yellow colonies are observed with the 3'-extended gRNA. A positive control that contains no stop codon is shown as well.

This result establishes that long double stranded substrates can undergo TPRT, and that TPRT products induce editing in eukaryotic cells.

Another experiment similar to the foregoing prime editing experiment was carried out, but instead of installing a point mutation in the stop codon, TRT editing installs a single nucleotide insertion (left) or deletion (right) that repairs a frameshift mutation and allows for synthesis of downstream mCherry (see FIG. 11). Both experiments used 3' extended gRNAs. Individual colonies from the TRT transformations were selected and analyzed by Sanger sequencing (see FIG. 12). Green colonies contained plasmids with the original DNA sequence, while yellow colonies contained the precise mutation designed by the TRT editing gRNA. No other point mutations or indels were observed.

Establish Prime Editing in HEK Cells Using RT-Cas9 Architectures

The optimized constructs from previous aims will be adapted for mammalian expression and editing at targeted sites in the human genome. Multiple RT enzymes and fusion architectures will be tested, in addition to adjacent targeting with secondary gRNAs (truncated to prevent nicking). Non-covalent RT recruitment will also be evaluated using the Sun-Tag system[52] and MS2 aptamer system[53]. Indel formation assays will be used to evaluate targeting efficiency with standard gRNAs and RT-Cas9 fusions (as above). Then, for each genomic site, extended gRNAs and RT-Cas9 pairs will be assayed for single nucleotide editing. Editing outcomes will be evaluated with MiSeq.

Initial experiments in HEK cells were performed using Cas9-RT fusions. Editing by components expressed within cells requires a Cas9(H840A) nickase, a reverse transcriptase (expressed as a fusion or supplied in trans), and an engineered gRNA with a 3' extension (see FIG. 14). Preliminary studies indicated that the length of the primer binding site within the gRNA extension was important for increasing the efficiency of editing in human cells (see FIG. 15).

Optimize Prime Editing Parameters in HEK Cells

After identifying Cas9-RT architectures that can perform prime editing in cells, the components and design will be optimized to achieve high efficiency editing. The location and nucleotide identity of the encoded point mutation, and the total length of the newly synthesized DNA strand, will be varied to evaluate editing scope and potential limitations. Short insertion and deletion mutations will also be evaluated. Protein expression constructs will be codon optimized. If successful, this would establish efficient prime editing in mammalian cells.

Preliminary Result. Additional gRNAs were designed to bring the RT enzyme to a higher local concentration at the editing locus, in the event that intramolecular reverse transcription by the fused RT enzyme were not possible. These auxiliary guides are truncated at the 5' end (14-15 nt spacer), which has previously been shown to prevent Cas9 cutting but retain binding (see FIG. 16). The HEK3 locus was chosen to explore this strategy.

Potential Difficulties and Alternatives 1) gRNA degradation in cells: if extended gRNA termini are truncated in cells, stabilizing secondary structures could be installed, or synthetic gRNAs with stabilizing modifications could be tested. (2) No observed editing in human cells: additional strategies will be explored, including secondary targeting of RT-Cas9 fusions to adjacent genomic sites[54]. In addition, potential directed evolution strategies in E. coli or S. cerevisiae could be explored.

Significance

If prime editing could be established in experimental cell lines, this would have an immediate impact for basic biomedical research by enabling the rapid generation and characterization of a large number of point mutations in human genes. The generality of the method, and its orthogonal editing window with respect to base editors, would provide an approach to installing many currently inaccessible mutations. Moreover, if prime editing could be optimized for high efficiency and product purity, its potential applicability to correcting disease mutations in other human cell types would be significant.

3. Achieve Site-Specific Editing of Pathogenic Mutations in Cultured Human Cells.

Background and Rationale.

A large number of pathogenic mutations cannot be corrected by current base editors due to PAM restrictions, or a need for transversion or indel mutation correction. With prime editing, all transitions and transversions are theoretically possible, as may be small insertions and deletions. Moreover, in relation to the PAM, the prime editing window (anticipated −3 to +4) is distinct from that of base editors (−18 to −12) (FIG. 13). Mendelian conditions not currently correctable by base editors include: (1) the sickle cell disease Glu6Val founder mutation in hemoglobin beta (requires A.T to T.A transversion); (2) the most common Wilson's disease variant His1069Gln in ATP7B (requires G.C to T.A transversion); and (3) the ΔPhe508 mutation in CFTR that causes cystic fibrosis (requires 3-nucleotide insertion). Each of these targets contains an appropriately positioned PAM for SpCas9 targeting and prime editing.

Preliminary Results.

T to A Editing in HEK3 Cells is not Achievable by Current Base Editing but is Achievable by TRPT Editing (See FIGS. 17A-17C).

FIG. 17A shows a graph displaying the % T to A conversion at the target nucleotide after transfection of components in human embryonic kidney (HEK) cells. This data presents results using an N-terminal fusion of wild type MLV reverse transcriptase to Cas9(H840A) nickase (32-amino acid linker). Editing efficiency was improved dramatically when the length of the primer binding site is extended from 7 nucleotides to 11 or 12 nucleotides. Additionally, the auxiliary guide A, which is positioned just upstream of the editing locus (see FIG. 16), significantly improves editing activity, particularly for shorter length primer binding sites. Editing efficiency was quantified by amplicon sequencing using the Illumina MiSeq platform. FIG. 17B also shows % T to A conversion at the target nucleotide after transfection of components in human embryonic kidney (HEK) cells, but this data presents results using a C-terminal fusion of the RT enzyme. Here, the auxiliary guide A does not have as much of an effect, and editing efficiency is overall higher. FIG. 17C shows data presenting results using an N-terminal fusion of wild type MLV reverse transcriptase to Cas9(H840A) nickase similar to that used in FIG. 17A; however the linker between the MLV RT and Cas9 is 60 amino acids long instead of 32 amino acids.

T to A Editing at HEK3 Site by TRPT Editing Results Displays High Purity.

FIG. 18 shows the output of sequencing analysis by high-throughput amplicon sequencing. The output displays the most abundant genotypes of edited cells. Of note, no major indel products are obtained, and the desired point mutation (T to A) is cleanly installed without bystander edits. The first sequence shows the reference genotype. The top two products are the starting genotype containing an endogenous polymorphism (G or A). The bottom two products represent the correctly edited genotypes.

MLV RT Mutants Improve Editing.

Mutant reverse transcriptases, described in Baranauskas, et al (doi:10.1093/protein/gzs034), were tested as C-terminal fusions to the Cas9(H840A) nickase for target nucleotide editing in human embryonic kidney (HEK) cells. Cas9-RT editor plasmid was co-transfected with a plasmid encoding a 3'-prime editing guide RNA that templates reverse transcription. Editing efficiency at the target nucleotide (blue bars) is shown alongside indel rates (orange bars) in FIG. 19. WT refers to the wild type MLV RT enzyme. The mutant enzymes (M1 through M4) contain the mutations listed to the right. Editing rates were quantified by high throughput sequencing of genomic DNA amplicons.

Complementary Strand Nicking with a Second gRNA Improves Editing.

This experiment evaluates editing efficiency of the target nucleotide when a single strand nick is introduced in the complementary DNA strand in proximity to the target nucleotide, with the hypothesis being that this would direct mismatch repair to preferentially remove the original nucleotide and convert the base pair to the desired edit. The Cas9(H840A)-RT editing construct was co-transfected with two guide RNA encoding plasmids, one of which templates the reverse transcription reaction, while the other targets the complementary DNA strand for nicking. Nicking at various distances from the target nucleotide was tested (orange triangles) (see FIG. 20). Editing efficiency at the target base pair (blue bars) is shown alongside the indel formation rate (orange bars). The "none" example does not contain a complementary strand nicking guide RNA. Editing rates were quantified by high throughput sequencing of genomic DNA amplicons.

FIG. 21 shows processed high throughput sequencing data showing the desired T to A transversion mutation and general absence of other major genome editing byproducts.

Scope. The potential scope for the new editing technology is shown in FIG. 13 and is compared to deaminase-mediated base editor technologies. Previously developed base editors target a region ~15±2 bp upstream of the PAM. By converting target C or A nucleotides to T or G, respectively, previously developed base editors enable all transition mutations (A:T to G:C conversions). However, previously developed base editors are unable to install transversion mutations (A to T, A to C, G to T, G to C, T to A, T to G, C to A, C to G). Moreover, if there are multiple target nucleotides in the editing window, additional undesired edits can result.

The new prime editing technology could theoretically install any nucleotide and base pair conversion, and potentially small insertion and deletion edits as well. With respect to the PAM, prime editing windows start at the site of DNA nicking (3 bases upstream of the PAM) and end at an as-of-yet undetermined position downstream of the PAM. Of note, this editing window is distinct from that of deaminase base editors. Because the TPRT systems performs editing using DNA polymerase enzymes, it potentially has all of their benefits including generality, precision, and fidelity.

Correct Pathogenic Mutations in Patient-Derived Cell Lines.

Cell lines harboring the relevant mutations (sickle cell disease: CD34+ hematopoietic stem cells; Wilson's disease: cultured fibroblasts; cystic fibrosis: cultured bronchial epithelia) will be obtained from ATCC, the Coriell Biobank, or collaborating Harvard/Broad affiliate laboratories. Editing efficiency will be evaluated by high throughput sequencing, and the efficacy of the corrected genotype will be tested using phenotypic assays (hemoglobin HPLC, ATP7B immunostaining, and CFTR membrane potential assays).

Characterize Off-Target Editing Activity.

Potential off-target editing will be screened with established methods such as GUIDE-seq[55] and CIRCLE-seq[56] using target gRNAs paired with wild type Cas9. If potential off-targets are identified, these loci will be probed in TPRT edited cells to identify true off-target editing events.

Potential Difficulties and Alternatives.

(1) Low editing efficiency: prime editor (PE)s may require optimization for each target. In this case, gRNA libraries can be tested to identify the highest functioning variants for specific applications. RT-Cas fusion expression and nuclear localization can be optimized. Liposomal RNP delivery could be used to limit off-target editing.

Upcoming Experiments.

Optimization of gRNA designs can be achieved by further exploration of the primer binding site length and extension of synthesis template. Testing scope and generality will include different nucleotide conversions, small insertions and deletions, as well as, different editing positions with respect to PAM, and multiple sites in the human genome. Optimization of RT component will include exploring mutations in MLV RT to enhance activity (Rnase H inactivation, increase primer-template binding affinity, adjustments to processivity), and new RT enzymes (group II intro RTs, other retroviral RTs).

Significance.

Myriad genetic disorders result from single nucleotide changes in individual genes. Developing the genome editing technology described here, and applying it in disease-relevant cell types, would establish a foundation for translation to the clinic. For some diseases, such as Sickle Cell Disease, a single point mutation represents the dominant genotype throughout the population. However, for many other genetic disorders, a large heterogeneity of different point mutations within a single gene is observed throughout the patient population, each of which gives rise to a similar disease phenotype. Therefore, as a general genome editing method that could in theory target a large number of such mutations, this technology could provide enormous potential benefit to many of these patients and their families. If proof of principle for these applications could be established in cells, it would establish the foundation to studies in animal models of disease.

Advantages

Precision: the desired edit is encoded directed in nucleic acid sequence. Generality: in theory, could be possible to make any base pair conversion, including transversion edits, as well as small insertions or deletions. There is a distinct editing window from that of base editors with respect to Cas9 protospacer adjacent motif (PAM) sequence. This method achieves many of the editing capabilities of homology-directed repair (HDR), but without the major limitations of HDR (inefficient in most cell types, and is usually accompanied by an excess of undesired byproducts such as indels). Also, it does not make double-stranded DNA breaks (DSBs, so few indels, translocations, large deletions, p53 activation, etc.

Example 2—Error-Prone Prime Editing (PE)

Prime editing (PE) systems described herein may also be used in conjunction with an error-prone reverse transcriptase enzyme to install mutations in a genome.

An embodiment is depicted in FIG. 22, which is a schematic of an exemplary process for conducting targeted mutagenesis with an error-prone reverse transcriptase on a target locus using a nucleic acid programmable DNA binding protein (napDNAbp) complexed with an extended guide RNA. This process may be referred to as an embodiment of prime editing for targeted mutagenesis. The extended guide RNA comprises an extension at the 3' or 5' end of the guide RNA, or at an intramolecular location in the guide RNA. In step (a), the napDNAbp/gRNA complex contacts the DNA molecule and the gRNA guides the napDNAbp to bind to the target locus to be mutagenized. In step (b), a nick in one of the strands of DNA of the target locus is introduced (e.g., by a nuclease or chemical agent), thereby creating an available 3' end in one of the strands of the target locus. In certain embodiments, the nick is created in the strand of DNA that corresponds to the R-loop strand, i.e., the strand that is not hybridized to the guide RNA sequence. In step (c), the 3' end DNA strand interacts with the extended portion of the guide RNA in order to prime reverse transcription. In certain embodiments, the 3' ended DNA strand hybridizes to a specific RT priming sequence on the extended portion of the guide RNA. In step (d), an error-prone reverse transcriptase is introduced which synthesizes a mutagenized single strand of DNA from the 3' end of the primed site towards the 3' end of the guide RNA. Exemplary mutations are indicated with an asterisk "*". This forms a single-strand DNA flap comprising the desired mutagenized region. In step (e), the napDNAbp and guide RNA are released. Steps (f) and (g) relate to the resolution of the single strand DNA flap (comprising the mutagenized region) such that the desired mutagenized region becomes incorporated into the target locus. This process can be driven towards the desired product formation by removing the corresponding 5' endogenous DNA flap that forms once the 3' single strand DNA flap invades and hybridizes to the complementary sequence on the other strand. The process can also be driven towards product formation with second strand nicking, as exemplified in FIG. 1F. Following endogenous DNA repair and/or replication processes, the mutagenized region becomes incorporated into both strands of DNA of the DNA locus.

Example 3—Trinucleotide Repeat Contraction with PE

The prime editing system or prime editing (PE) system described herein may be used to contract trinucleotide repeat mutations (or "triplet expansion diseases") to treating conditions such as Huntington's disease and other trinucleotide repeat disorders. Without wishing to be bound by theory, triplet expansion is caused by slippage during DNA replication or during DNA repair synthesis. Because the tandem repeats have identical sequence to one another, base pairing between two DNA strands can take place at multiple points along the sequence. This may lead to the formation of "loop out" structures during DNA replication or DNA repair synthesis. This may lead to repeated copying of the repeated sequence, expanding the number of repeats. Additional mechanisms involving hybrid RNA:DNA intermediates have been proposed. Prime editing may be used to reduce or eliminate these triplet expansion regions by deletion one or more or the offending repeat codon triplets. In an embodiment of this use, FIG. 23, provides a schematic of a PEgRNA design for contracting or reducing trinucleotide repeat sequences with prime editing.

Thus, prime editing may be able to be used to correct any trinucleotide repeat disorder, including, Huntington's disease, Fragile X syndrome, and Friedreich's ataxia.

The most common trinucleotide repeat contains CAG triplets, though GAA triplets (Friedreich's ataxia) and CGG triplets (Fragile X syndrome) also occur. The CAG triplets code for glutamine (Q), thus, CAG repeats result in polyglutamine tracts in the coding regions of diseased proteins. This particular class of trinucleotide repeat disorders are also called "polyglutamine (PolyQ) diseases." Other trinucleotide repeats can cause alterations in gene regulation and are referred to as "non-polyglutamine diseases." Inheriting a predisposition to expansion, or acquiring an already expanded parental allele, increases the likelihood of acquiring the disease. Pathogenic expansions of trinucleotide repeats could be corrected using prime editing.

Prime editing may be implemented to contract triplet expansion regions by nicking a region upstream of the triplet repeat region with the prime editor comprising a PEgRNA appropriated targeted to the cut site. The prime editor then synthesizes a new DNA strand (ssDNA flap) based on the PEgRNA as a template (i.e., the edit template thereof) that codes for a healthy number of triplet repeats (which depends on the particular gene and disease). The newly synthesized ssDNA strand comprising the healthy triplet repeat sequence also is synthesized to include a short stretch of homology (i.e., the homology arm) that matches the sequence adjacent to the other end of the repeat (red strand). Invasion of the newly synthesized strand, and subsequent replacement of the endogenous DNA with the newly synthesized ssDNA flap, leads to a contracted repeat allele.

Example 4—Peptide Tagging with PE

The prime editing systems (i.e., PE systems) described herein may also be used to introduce various peptide tags into protein coding genes. Such tags can include HEXAhistidine tags, FLAG-tag, V5-tag, GCN4-tag, HA-tag, Myc-tag and others. This approach may be useful in applications such as protein fluorescent labeling, immunoprecipitation, immunoblotting, immunohistochemistry, protein recruitment, inducible protein degrons, and genome-wide screening. Embodiments are depicted in FIGS. 25 and 26.

FIG. 25 is a schematic showing gRNA design for peptide tagging genes at endogenous genomic loci and peptide tagging with TPRT genome editing (i.e., prime editing). The FlAsH and ReAsH tagging systems comprise two parts: (1) a fluorophore-biarsenical probe, and (2) a genetically encoded peptide containing a tetracysteine motif, exemplified by the sequence FLNCCPGCCMEP (SEQ ID NO: 1). When expressed within cells, proteins containing the tetracysteine motif can be fluorescently labeled with fluorophore-arsenic probes (see ref: J. Am. Chem. Soc., 2002, 124 (21), pp 6063-6076. DOI: 10.1021/ja017687n). The "sortagging" system employs bacterial sortase enzymes that covalently conjugate labeled peptide probes to proteins containing suitable peptide substrates (see ref: Nat. Chem. Biol. 2007 November; 3(11):707-8. DOI: 10.1038/nchembio.2007.31). The FLAG-tag (DYKDDDDK (SEQ ID NO: 2)), V5-tag (GKPIPNPLLGLDST (SEQ ID NO: 3)), GCN4-tag (EELLSKNYHLENEVARLKK (SEQ ID NO: 4)), HA-tag (YPYDVPDYA (SEQ ID NO: 5)), and Myc-tag (EQKLISEEDL (SEQ ID NO: 6)) are commonly employed as epitope tags for immunoassays. The pi-clamp encodes a peptide sequence (FCPF) (SEQ ID NO: 622) that can by labeled with a pentafluoro-aromatic substrates (ref: Nat. Chem. 2016 February; 8(2):120-8. doi: 10.1038/nchem.2413).

FIG. 26 shows precise installation of a His6-tag and a FLAG-tag into genomic DNA. A guide RNA targeting the HEK3 locus was designed with a reverse transcription template that encodes either an 18-nt His-tag insertion or a 24-nt FLAG-tag insertion. Editing efficiency in transfected HEK cells was assessed using amplicon sequencing. Note that the full 24-nt sequence of the FLAG-tag is outside of the viewing frame (sequencing confirmed full and precise insertion).

Example 5—Prevention or Treatment of Prion Disease with PE

This invention could help address the problem of prion disease in humans, livestock, and wildlife. No previously described editing strategy is efficient and clean enough to install protective mutations or to reliably knock down PRNP. Cas9 nuclease and HDR can be used but will generate mostly a mixture of PRNP indel variants some of which are thought to be pathogenic. Moreover, HDR does not work in most types of cells. Prime editing is reliable and efficient at installing both types of mutations without generating an excess of double-stranded DNA breaks or resulting indels.

This invention describes how to install a protective mutation in PRNP that prevents or halts the progression of prion disease. This site is conserved in mammals, so in addition to treating human disease it could also be used to generate cows and sheep that are immune to prion disease, or even help cure wild populations of animals that are suffering from prion disease. Prime editing has already been used to achieve ~25% installation of a naturally occurring protective allele in human cells, and previous mouse experiments indicate that this level of installation is sufficient to cause immunity from most prion diseases. This method is the first and potentially only current way to install this allele with such high efficiency in most cell types. Another possible strategy for treatment is to use prime editing to reduce or eliminate the expression of PRNP by installing an early stop codon in the gene. Many researchers predict that doing so would treat the disease.

Three potential therapeutic strategies include prime editing to reduce expression of PrP. This goal may be accomplished by the introduction of mutations that cause a premature stop codon in PRNP, eliminate the start codon, mutate or delete essential amino acids codons, introduce or remove splice sites to generate an aberrant transcript, or alter regulatory elements that reduce transcript levels. Prime editing to eliminate disease mutations. Many variants of PRNP have been described (ncbi.nlm.nih.gov/pmc/articles/PMC6097508/#b154-ndt-14-2067) that lead to an increased likelihood of contracting disease. Each known variant could be reversed using prime editing, since prime editing can make all possible types of point mutations, local insertions, and local deletions. Prime editing to introduce one or more protective mutations into PRNP that disrupt prion formation and/or transmission. For example, G127V in the human PRNP gene has been demonstrated to protect against many forms of prion disease (ncbi.nlm.nih.gov/pmc/articles/PMC4486072/). This mutation was later described to interfere with prion formation by preventing formation of stable beta sheets and dimers (ncbi.nlm.nih.gov/pubmed/30181558, ncbi.nlm.nih.gov/pubmed/26906032). In addition to the introduction of single nucleotide polymorphisms, the insertion or deletion of sequences in PRNP that would interfere with prion formation could also be used to protect from or treat prion disease.

The third therapeutic strategy is particularly advantageous because the introduction of protective variants could confer a benefit even when a relatively small number of cells experience the edit. Furthermore, the introduction of protective variants, especially those naturally occurring in human populations such as G127V, would not be expected to have any detrimental consequences, while reducing expression of prion protein as in strategy 1 could have some detrimental phenotypes, as have been documented in PRNP knock-out mice (ncbi.nlm.nih.gov/pmc/articles/PMC4601510/, ncbi.nlm.nih.gov/pmc/articles/PMC2634447/).

It has previously been demonstrated that mice expressing a ratio of approximately 2:1 of the wild type human prion protein: the protective G127V variant of the human prion protein (approximately 33% expression of the protective variant) were entirely immune to most tested forms of prion disease and were also resistant to variant Creutzfeldt-Jakob disease (vCJD), the human disease transmitted from bovine spongiform encephalopathy (BSE, or mad cow disease)[91]. Mice that only expressed the protective G127V variant were entirely immune to all tested prion disease challenges, including vCJD.

It is demonstrated herein that the protective G127V mutation can be efficiently installed in human cells in tissue culture using prime editing (see FIG. 27).

Informed by these results, three settings are described in which PRNP editing could be used. One setting PRNP editing can be used is prime editing in human patients to prevent or treat prion disease. A second setting PRNP editing can be used is prime editing in livestock to prevent the occurrence and spread of prion disease. Both cow and sheep livestock have experienced sporadic occurrence of prion disease caused by the protein generated by the PRNP gene. In addition to the debilitating and deadly disease suffered by the animal, these cases are also economically devastating, in part due to the care that must be taken to prevent the spread of the extremely infectious disease. A single dairy cow in the state of Washington tested positive for BSE in December of 2003, which led to a projected loss of 2.8-4.2 billion dollars in beef sales the following year bookstore.ksre.ksu.edu/pubs/MF2678.pdf). The PRNP gene is highly conserved in mammals. Introducing a PRNP mutation such as G127V into the livestock germline could eliminate the occurrence of BSE or scrapie, the manifestation of prion disease in sheep. A third setting PRNP editing can be used is prime editing in wildlife could prevent the spread of wild prion disease. Currently, cervid populations including deer, elk, and moose in North America are suffering from chronic wasting disease (CWD), a manifestation of prion disease caused by PNRP in these species. The occurrence has been reported to be as high as 25% in some populations (cdc.gov/prions/cwd/occurrence.html). CWD has also been reported in Norway, Finland, and South Korea. It is not yet known whether the disease is transmissible from these species to humans (cdc.gov/prions/cwd/transmission.html) or livestock. The introduction of PRNP mutations such as G127V in the germline of these species could protect them from CWD and reduce the risk of transmission to other species including humans.

This method could be used to treat Creutzfeldt-Jakob Disease (CJD), kuru, Gerstmann-Sträussler-Scheinker disease, fatal familial insomnia (FFI), bovine spongiform encephalopathy (BSE; mad cow disease), scrapie (in sheep), and chronic wasting disease (CWD; in deer, elk, and moose).

The method would need to be combined with a delivery methodology for embryos or adult neurons, such as microinjection, lipid nanoparticles, or AAV vectors.

Example 6—RNA Tagging and Manipulation Using PE

A new method for the insertion of motifs into genetic sequences that tag or otherwise manipulate RNA within mammalian, eukaryotic, and bacterial cells is described herein. While it is estimated that only 1% of the human genome encodes proteins, virtually all of the genome is transcribed at some level. It is an open question how much of the resulting non-coding RNA (ncRNA) plays a functional role, let alone what the roles of most of these putative RNAs are. "Tagging" of these RNA molecules via the insertion of a novel RNA-encoding sequence with a useful property into genes of interest is a useful method for studying the biological functions of RNA molecules in cells. It can also be useful install tags onto protein-encoding mRNAs as a means to perturb and thus better understand how mRNA modifications can affect cellular function. For instance, a ubiquitous natural RNA tag—polyadenylation—is used by cells to affect transport of mRNA into the cytoplasm. Different types of polyadenylation signals result in different transport rates and different mRNA lifespans and—thus—differences in the levels to which the encoded protein is expressed.

A common approach for expressing tagged RNAs within cells is to exogenously introduce a synthetic construct using either (i) transient plasmid transfection that produces a short-term burst of gene expression, often at supraphysiologic levels; or (ii) permanent integration of the tagged RNA gene into the genome (at random sites) using lentiviral integration or transposons, which enables prolonged expression. Both of these approaches are limited by production of altered expression levels, and by the absence of natural mechanisms that regulate the expression or activity of the gene. An alternative strategy is to directly tag a gene of interest at its endogenous locus using homology-directed repair (HDR) of double-stranded DNA breaks induced by Cas9 or other targeted DNA nucleases. While this approach enables the generation of a wide range of endogenously tagged genes, HDR is markedly inefficient and so requires significant screening to identify the desired clonal population of cells that have been successfully tagged. Moreover, HDR is typically very inefficient or entirely inactive in a large number of cell types, most notably in post-mitotic cells. The low efficiency of HDR is further complicated by the generation of undesired indel products, would could be especially problematic in the case of RNA genes as they might lead to the production of an RNA whose activities interfere with the function of normal alleles. Finally, researchers often need to screen various tagging positions within an RNA molecule to achieve optimal performance. Combined, these drawbacks make HDR a less desirable method for installation of tags in RNA.

Prime editing is a new genome editing technology that enables targeted editing of genomic loci via the transfer of genetic information from RNA to DNA. Using prime editing, RNA genes could be tagged with a variety of components such as RNA aptamers, ribozymes, or other RNA motifs. Prime editing has the potential to be faster, cheaper, and effective in a greater variety of cell types by comparison to HDR strategies. As such, the described invention represents a novel, useful, and non-obvious tool for investigating the biology of RNA genes in health and disease. A new method for the insertion of RNA motifs into genetic sequences that tag or otherwise manipulate RNA using prime editors (PEs) is described herein. PEs are capable of site-specifically inserting, mutating, and/or deleting multiple nucleotides at a desired genomic locus that is targetable by a CRISPR/Cas system. PEs are composed of fusions between Cas9 nuclease domains and reverse transcriptase domains. They are guided to their genomic target by engineered PEgRNAs (prime editing guide RNAs), which contain a guide spacer portion for DNA targeting, as well as a template for reverse transcription that encodes the desired genome edit (see FIG. 28A). It is envisioned that PE can be used to insert motifs that are functional at the RNA level (hereafter RNA motifs) to tag or otherwise manipulate non-coding RNAs or mRNAs. These motifs could serve to increase gene expression, decrease gene expression, alter splicing, change post-transcriptional modification, affect the sub-cellular location of the RNA, enable isolation or determination of the intra- or extra-cellular location of the RNA (using, for instance, fluorescent RNA aptamers such as Spinach, Spinach2, Baby Spinach, or Broccoli), recruit endogenous or exogenous protein or RNA binders, introduce sgRNAs, or induce processing of the RNA, by either self-cleavage or RNAses (see FIG. 28B). Due to the flexibility of prime editing, it is not possible to provide a comprehensive list of RNA motifs that could be installed within the genome. A series of examples are shown here that broadly illustrate the predicted scope of PE-installed RNA motifs that could be used to tag RNA genes. It is currently not possible to efficiently and fairly cleanly make these changes in most types of cells (including the many that do not support HDR) using any other reported genome editing method besides PE.

Gene expression could be affected by encoding a 3' untranslated region (UTR) that results in changes in nuclear transport or retention or mRNA lifespan. For instance, the polyA tail from polyomavirus simian virus 40 (SV40) has additional helper sequences that enable efficient transcription termination and can increase gene expression relative to other 3' UTRs[57,58]. Example sequence of SV40 polyA tail:

```
                                    (SEQ ID NO: 331)
SV40 POLYA TAIL    AACTTGTTTATTGCAGCTTATAATGGTTA

CAAATAAAGCAATAGCATCACAAATTTCA

CAAATAAAGCATTTTTTTCACTGCATTCT

AGTTGTGGTTTGTCCAAACTCATCAATGT

ATCTTA
```

Post-translational modification signals, besides polyadenylation signals, could also be encoded by PE. These include signals incorporate N6-methyladenosine, N1-methyladenosine, 5-methylcytosine, and pseudouridine modifications[59]. By using PE to include sequences bound by enzymes that write or remove these modifications within an RNA transcript, it would be possible to induce their writing or erasing. This could be used as a tool to study the effects of these markers, to induce cellular differentiation, affect stress responses, or, given the function of these markers are as yet underexplored, affect targeted cells in other fashions.

PE could encode mutations that affect subcellular localization. For instance, incorporation of tRNA-Lys within an mRNA can theoretically result in transport to the mitochondria[60], while various 3' UTRs can result in nuclear retention or transport[61].

EXAMPLES

SV40 polyA signal results in transport.

```
                                    (SEQ ID NO: 331)
SV40 POLYA TAIL    AACTTGTTTATTGCAGCTTATAATGGTTACA

AATAAAGCAATAGCATCACAAATTTCACAAA

TAAAGCATTTTTTTCACTGCATTCTAGTTGT

GGTTTGTCCAAACTCATCAATGTATCTTA
```

U1 snRNA 3' box results in retention.

```
                                    (SEQ ID NO: 625)
U1 SNRNA 3' BOX    TTCATTCAGCAAGTTCAGAGAAATCTGAAC

TTGCTGGATTTTTGGAGCAGGGAGATGGAA

TAGGAGCTTGCTCCGTCCACTCCACGCATC

GACCTGGTATTGCAGTACCTCCAGGAACGG

TGCACCCACTTTCTGGAGTTTCAAAAGTAG

ACTGTACGCTAAGGGTCATATCTTTTTTTG

TTT GGTTTGTGTCTTGGTTGGCGTCTTAA
```

Determining the sub-cellular localization of endogenous RNA can be challenging and requires the addition of exogenous, fluorescently-tagged nucleotide probes, as in the case of FISH, or time-consuming and potentially inaccurate cell fractionation followed by RNA detection. Encoding a probe within the endogenous RNA would obviate many of these issues. One example would be to encode a fluorescent RNA aptamer, such as Spinach[62] or Broccoli within an endogenous RNA, thereby visualizing the presence of that RNA via addition of a small molecule proto-fluorophore.

Broccoli Aptamer:

```
                                    (SEQ ID NO: 357)
BROCCOLI APTAMER   GAGACGGTCGGGTCCAGATATTCGTATCTGTC

GAGTAGAGTGTGGGCTC
```

PE could insert or remove sequences that encode RNA that are recognized by RNA binding proteins, affecting RNA stability, expression, localization, or modification (for instance, see proteins listed[63]).

PE could insert sequences that encode sgRNAs within the genome, as a viral or cancer defense mechanism. Similarly, it could be used to insert microRNAs (e.g., pre-microRNAs) to direct silencing of targeted genes.

PE could insert sequences resulting in processing of the RNA, either by itself, or by external factors, either as a therapy or tool for studying the function of various portions of the RNA. For instance, the HDV ribozyme[64], when included within an RNA sequence, results in processing of the RNA immediately 5' of the ribozyme, while the hammerhead ribozyme cleaves prior to the third stem within the ribozyme[65]. Other self-cleaving ribozymes include pistol[66], hatchet[66], hairpin[67], Neuropora Varkud satellite[68], glmS[69], twister[70], and twister sister[66]. These sequences could include wild-type or engineered or evolved versions of ribozymes. The majority of these ribozymes could have different sequences depending on the region of RNA into which they were associated, depending on where the ribozyme cut site is located. Sequences that would direct the processing of the RNA by external factors, such as sequence specific RNAses[71], RNAses that recognize specific structures[72]—such as Dicer[73] and Drosha[74], could also be achieved.

HDV Ribozyme:

| | | |
|---|---|---|
| | | (SEQ ID NO: 365) |
| HDV RIBOZYME | GGCCGGCATGGTCCCAGCCTCCTCGCTGGCG | |
| | CCGGCTGGGCAACATGCTTCGGCATGGCGAA | |
| | TGGGAC | |

References for Example 6

The following references are incorporated herein by reference in their entireties.
1. Schek N, Cooke C, Alwine J C. Molecular and Cellular Biology. 1992.
2. Gil A, Proudfoot N J. Cell. 1987.
3. Zhao, B. S., Roundtree, I. A., He, C. Nat Rev Mol Cell Biol. 2017.
4. Rubio, M. A. T., Hopper, A. K. Wiley Interdiscip Rev RNA 2011.
5. Shechner, D. M., Hacisuleyman E., Younger, S. T., Rinn, J. L. Nat Methods. 2015.
6. Paige, J. S., Wu, K. Y., Jaffrey, S. R. *Science* 2011.
7. Ray D., . . . Hughes T R. Nature 2013.
8. Chadalavada, D. M., Cerrone-Szakal, A. L., Bevilacqua, P. C. RNA 2007.
9. Forster A C, Symons R H. Cell. 1987.
10. Weinberg Z, Kim P B, Chen T H, Li S, Harris K A, Lünse C E, Breaker R R. Nat. Chem. Biol. 2015.
11. Feldstein P A, Buzayan J M, Bruening G. Gene 1989.
12. Saville B J, Collins R A. Cell. 1990.
13. Winkler W C, Nahvi A, Roth A, Collins J A, Breaker R R. Nature 2004.
14. Roth A, Weinberg Z, Chen A G, Kim P G, Ames T D, Breaker R R. Nat Chem Biol. 2013.
15. Choudhury R, Tsai Y S, Dominguez D, Wang Y, Wang Z. Nat Commun. 2012.
16. MacRae I J, Doudna J A. Curr Opin Struct Biol. 2007.
17. Bernstein E, Caudy A A, Hammond S M, Hannon G J Nature 2001.
18. Filippov V, Solovyev V, Filippova M, Gill S S. Gene 2000.

Example 7—Generation of Gene Libraries with PE

A new method for the cellular generation of highly sophisticated libraries of protein- or RNA-coding genes with defined or variable insertions, deletions, or defined amino acid/nucleotide conversions, and their use in high-throughput screening and directed evolution is described herein. The references cited in the Example are based from the list of references included at the end of this Example.

The generation of variable genetic libraries has most commonly been accomplished through mutagenic PCR[1]. This method relies on either using reaction conditions that reduce the fidelity of DNA polymerase, or using modified DNA polymerases with higher mutation rates. As such, biases in these polymerases are reflected in the library product (e.g. a preference for transition mutations versus transversions). An inherent limitation of this approach to library construction is a relative inability to affect the size of the gene being varied. Most DNA polymerases have extremely low rates of indel mutations[2] (insertions or deletions), and most of these will result in frameshift mutations in protein-coding regions, rendering members of the library unlikely to pass any downstream selection. Additionally, biases in PCR and cloning can make it difficult to generate single libraries consisting of genes of different sizes. These limitations can severely limit the efficacy of directed evolution to enhance existing or engineer novel protein functions. In natural evolution, large changes in protein function or efficacy are typically associated with insertion and deletion mutations that are unlikely to occur during canonical library generation for mutagenesis. Furthermore, these mutations most commonly occur in regions of the protein in question that are predicted to form loops, as opposed to the hydrophobic core. Thus, most indels generated using a traditional unbiased approach are likely to either be deleterious or ineffective.

Libraries that could bias such mutations to the sites within the protein where they would be most likely to be beneficial, i.e. loop regions, would have a significant advantage over traditional libraries given that all libraries access only a fraction of the possible mutation space. Finally, although it is possible to generate genetic libraries with site-specific indel mutations through multistep PCR and clonal assembly using NNK primers or via DNA shuffling, these libraries cannot undergo additional rounds of 'indelgenesis' in continual evolution. Continuous evolution is a type of directed evolution with minimal user intervention. One such example is PACE[3]. Because continuous evolution occurs with minimal user intervention, any increase in library diversity during the evolution must occur using the native replication machinery. As such, although libraries of genes with inserted or removed codons as specific loci can be generated and screened in PACE, additional rounds of 'indelgenesis' are not possible.

It is envisioned that the programmability of prime editing (PE) can be leveraged to generate highly sophisticated, programmed genetic libraries for use in high-throughput screening and directed evolution (see FIG. 29A). PE can insert, change or remove defined numbers of nucleotides from specified genetic loci using information encoded in a prime editing guide RNA (PEgRNA) (see FIG. 29B). This enables the generation of targeted libraries with one or more amino acids inserted or removed from the loop regions wherein mutations are most likely to give rise to changes in function, without background introduction of nonfunctional frameshift mutations (see FIG. 29C). PE can be used to install specific sets of mutations without regard for biases inherent in either DNA polymerase or the sequence being mutated.

For instance, while converting a CCC codon to a stop codon would be an unlikely occurrence via canonical library generation because it would require three consecutive mutations, including two transversions, PE could be used to convert any given, targeted codon to a TGA stop codon in one step. They could also be used to install programmed diversity at given positions, for instance by incorporating codons encoding any hydrophobic amino acid at a given site, while not encoding any others. Furthermore, because of the programmability of PE, multiple PEgRNAs could be utilized to generate multiple different edits at multiple sites simultaneously, enabling the generation of highly programmed libraries (see FIG. 29D). Additionally, it is possible to use reverse transcriptases with lower fidelity to generate regions of mutagenesis within an otherwise invariable library (such as the HIV-I reverse transcriptase[4] or *Bordetella* phage reverse transcriptase[5]).

The possibility of iterative rounds of PE on the same site is also envisioned, allowing—for instance—the repeated insertion of codons at a single site. Finally, it is envisioned that all of the above described approaches can be incorporated into continual evolution, enabling the generation of novel in situ evolving libraries (see FIG. 30). They could also be used to construct these libraries within other cell types where it would otherwise be difficult to assemble large libraries, for instance within mammalian cells. Generation of PE-encoding bacterial strains that have been optimized for directed evolution would be a useful additional tool for the identification of proteins and RNAs with improved or novel functionality. All of these uses of PE are non-obvious due to the novel nature of PEs. In conclusion, library generation via PE would be a highly useful tool in synthetic biology and directed evolution, as well as for high-throughput screening of protein and RNA combinatorial mutants. Competing Approaches The chief method by which diverse libraries are currently generated is by mutagenic PCR[1], described above. Insertions or deletions can be introduced via degenerated NNK primers at defined sites during PCR, although introducing such mutations at multiple sites requires multiple rounds of iterative PCR and cloning before constructing a more diverse library via mutagenic PCR, rendering the method slow. An alternative, complementary method is DNA shuffling, where fragments of a library of genes generated via DNase treatment are introduced into a PCR reaction without primers, resulting in the annealing of different fragments to each other and the rapid generation of more diverse libraries than via mutagenic PCR alone[6]. Although this approach can theoretically generate indel mutations, it more often results in frameshift mutations that destroy gene function. Furthermore, DNA shuffling requires a high degree of homology between gene fragments. Both of these methods must be done in vitro, with the resulting library transformed into cells, while libraries generated by PE can be constructed in situ, enabling their use in continual evolution. While libraries can be constructed in situ through in vivo mutagenesis, these libraries rely on the host cellular machinery and exhibit biases against indels. Similarly, although traditional cloning methods can be used to generate site-specific mutational profiles, they cannot be used in situ and are generally assembled one at a time in vitro before being transformed into cells. The efficiency and broad functionality of PE in both prokaryotic and eukaryotic cell types further suggests that these libraries could be constructed directly in the cell type of interest, as opposed to being cloned into a model organism such as *E. coli* and then transferred into the cell or organism of interest. Another competing approach for targeted diversification is automated multiplex genome engineering, or MAGE, wherein multiple single-stranded DNA oligonucleotides can be incorporated within replication forks and result in programmable mutations[7]. However, MAGE requires significant modification of the host strain and can lead to a 100-fold increase in off-target or background mutations[8], whereas PE is more highly programmed and anticipated to result in fewer off-target effects. Additionally, MAGE has not been demonstrated in a wide variety of cell types, including mammalian cells. Prime editing is a novel and non-obvious complementary technique for library generation.

Examples of PE in Directed Evolution to Construct Gene Libraries

In one example, PE can be used in a directed evolution experiment to introduce protein variants into gene libraries during a continual evolution experiment using PACE, permitting iterative accumulation of both point mutations and indels in a manner not possible via traditional approaches. It has already been shown that PE can site-specifically and programmably insert nucleotides into a genetic sequence in *E. coli*. In the outlined directed evolution, it is proposed to identify monobodies with improved binding to a specific epitope via a modified two-hybrid protein:protein binding PACE selection. Specific and highly variable loops within these monobodies contribute significantly to affinity and specificity. Improved monobody binding might be obtained rapidly in PACE by varying the length and composition of these loops in a targeted fashion. However, varying sequence length is not an established functionality of PACE. While library of varied loop sizes might be used as a starting point for PACE, no subsequent improvements to length would arise throughout the PACE selection, barring access to beneficial synergistic combinations of point mutations and indel mutations. Introducing PE to the PACE selection would enable the in situ generation and evolution of monobodies with varying loop lengths. To do so, it is envisioned the introduction of an additional PE plasmid to the host *E. coli* strain, encoding the PE enzyme and one or more PEgRNAs. Expression of PE enzyme and PEgRNAs would be under the control of a small molecule delivered to the PACE lagoon at a rate selected by the experimenter.

In various embodiments, the PEgRNA components would contain a spacer directing the PE to the site of interest on the selection phage and would be designed such that a multiple of three nucleotides could be inserted at the target site such that a new PEgRNA binding site would be introduced, enabling the iterative insertion of one or more codons at the targeted site.

In parallel, another host *E. coli* strain might include PEgRNAs that would template the removal of one or more codons, enabling loop size to shrink during the evolution. A PACE experiment might utilize a mixture of both strains or alternate the two to permit the slow and controlled addition or removal of loop sequences.

It is noted that this technique can also be applied to the evolution of antibodies. The binding principles governing antibodies are very similar to those governing monobodies: the length of antibody complement-determining region loops is critical to their binding function. Further, longer loop lengths have been found to be critical in the development of rare antibodies with broadly protective activity against HIV-1 and other viral infections[9]. Application of PE as described above to an antibody or antibody-derived molecule would permit the generation of antibodies with diverse loop length and varied loop sequence. In combination with PACE, such an approach would permit enhanced binding through loop geometries not accessible to standard PACE, and thus permit evolution of highly functional antibodies.

Experiments will show the ability to use PE to correct a deleterious mutation in bacteriophage M3 in phage-assisted non-continuous evolution (PANCE), a necessary first step for using PE in continuous evolution (see FIG. 69).

References for Example 7

The following references are incorporated herein by reference in their entireties.
1. Cadwell R C and Joyce G F. PCR Methods Appl. 1992.
2. McInerney P, Adams P, and Hadi M Z. Mol Biol Int. 2014.
3. Esvelt K M, Carlson J C, and Liu D R. Nature. 2011.
4. Naorem S S, Hin J, Wang S, Lee W R, Heng X, Miller J F, Guo H. Proc Natl Acad Sci USA 2017.
5. Martinez M A, Vartanian J P, Wain-Hobson S. Proc Natl Acad Sci USA 1994.
6. Meyer A J, Ellefson J W, Ellington A D. Curr Protoc Mol Biol. 2014.
7. Wang H H, Isaacs F J, Carr P A, Sun Z Z, Xu G, Forest C R, Church G M. Nature. 2009.
8. Nyerges Á et al. Proc Natl Acad Sci USA. 2016.
9. Mascola J R, Haynes B F. Immunol Rev. 2013.

Example 8—Immunoepitope Insertion by PE

Precise genome targeting technologies using the CRISPR/Cas system have recently been explored in a wide range of applications, including the insertion of engineered DNA sequences into targeted genomic loci. Previously, homology-directed repair (HDR) has been used for this application, requiring an ssDNA donor template and repair initiation by means of a double-stranded DNA break (DSB). This strategy offers the broadest range of possible changes to be made in cells and is the only method available to insert large DNA sequences into mammalian cells. However, HDR is hampered by undesired cellular side effects stemming from its initiating DSB, such as high levels of indel formation, DNA translocations, large deletions, and P53 activation. In addition to these drawbacks, HDR is limited by low efficiency in many cell types (T cells are a notable exception to this observation). Recent efforts to overcome these drawbacks include fusing human Rad51 mutants to a Cas9 D10A nickase (RDN), resulting in a DSB-free HDR system that features improved HDR product:indel ratios and lower off target editing, but is still hampered by cell-type dependencies and only modest HDR editing efficiency.

Recently developed fusions of Cas9 to reverse transcriptases ("Prime editors") coupled with PEgRNAs represent a novel genome editing technology that offers a number of advantages over existing genome editing methods, including the ability to install any single nucleotide substitution, and to insert or delete any short stretch of nucleotides (up to at least several dozen bases) in a site-specific manner. Notably, PE edits are achieved with generally low rates of unintended indels. As such, PE enables targeted insertion-based editing applications that have been previously impossible or impractical.

This particular invention describes a method for using prime editing as a means to insert known immunogenicity epitopes into endogenous or foreign genomic DNA, resulting in modification of the corresponding proteins for therapeutic or biotechnological applications (see FIGS. 31 and 32). Prior to the invention of prime editing, such insertions could be achieved only inefficiently and with high rates of indel formation from DSBs. prime editing solves the problem of high indel formation from insertion edits while generally offering higher efficiency than HDR. This lower rate of indel formation presents a major advantage of prime editing over HDR as a method for targeted DNA insertions, especially in the described application of inserting immunogenicity epitopes. The length of epitopes is in a range from few bases to hundreds of bases. Prime editor is the most efficient and cleanest technology to achieve such targeted insertions in mammalian cells.

The key concept of the invention is the use of prime editors to insert a nucleotide sequence containing previously described immunogenicity epitopes into endogenous or foreign genomic DNA for the downregulation and/or destruction of their protein products and/or expressing cell types. Nucleotide sequences for immunogenic epitope insertion would be targeted to genes in a manner to produce fusion proteins of the targeted gene's coded protein and the inserted immunogenic epitope's corresponding protein translation. Patient's immune systems will have been previously trained to recognize these epitopes as a result of standard prior immunization from routine vaccination against, for example, tetanus or diphtheria or measles. As a result of the immunogenic nature of the fused epitopes, patient's immune systems would be expected to recognize and disable the prime edited protein (not just the inserted epitope) and potentially the cells from which it was expressed.

Fusions to targeted genes would be engineered as needed to ensure the inserted epitope protein translation is exposed for immune system recognition. This could include targeted nucleotide insertions resulting in protein translations yielding C-terminal fusions of immunogenicity epitopes to targeted genes, N-terminal fusions of immunogenicity epitopes to targeted genes, or the insertion of nucleotides into genes so that immunogenicity epitopes are coded within surfaced-exposed regions of protein structure.

Protein linkers encoded as nucleotides inserted between the target gene sequence and the inserted immunogenicity epitope nucleotide sequence may need to be engineered as part of this invention to facilitate immune system recognition, cellular trafficking, protein function, or protein folding of the targeted gene. These inserted nucleotide-encoded protein linkers may include (but are not limited to) variable lengths and sequences of the XTEN linker or variable lengths and sequences of Glycine-Serine linkers. These engineered linkers have been previous used to successfully facilitate protein fusions.

Distinguishing features of this invention include the ability to use previously acquired immune responses to specific amino acid sequences as a means to induce an immune response against otherwise non-immunogenic proteins. Another distinguishing feature is the ability to insert the nucleotide sequences of these immunogenic epitopes in a targets manner that does not induce high levels of unwanted indels as a by-product editing and is efficient in its insertion. The invention discussed herein also has the ability to combine cell type-specific delivery methods (such as AAV serotypes) to insert epitopes in cell types that are of interest to trigger an immune response to.

Prime editing as a means of inserting immunogenic epitopes into pathogenic genes could be used to program the patient's immune system to fight a wide variety of diseases (not limited to cancer as with immuno-oncology strategies). An immediately relevant use of this technology would be as a cancer therapeutic as it could undermine a tumor's immune escape mechanism by causing an immune response to a relevant oncogene like HER2 or growth factors like EGFR. Such an approach could seem similar to T-cell engineering, but one novel advance of this approach is that it can be utilized in many cell types and for diseases beyond cancer, without needed to generate and introduce engineered T-cells into patients.

Using PE to insert an immunogenicity epitope which most people are already vaccinated against (tetanus, pertussis, diphtheria, measles, mumps, rubella, etc.) into a foreign or endogenous gene that drives a disease, so the patient's immune system learns to disable that protein.

Diseases that stand to have a potential therapeutic benefit from the aforementioned strategy include those caused by aggregation of toxic proteins, such as in fatal familial insomnia. Other diseases that could benefit include those caused by pathogenic overexpression of an otherwise non-toxic endogenous protein, and those caused by foreign pathogens.

Primary therapeutic indications include those mentioned above such as therapeutics for cancer, prion and other neurodegenerative diseases, infectious diseases, and preventative medicine. Secondary therapeutic indications may include preventative care for patients with late-onset genetic diseases. It is expected that current standard of care medicines may be used in conjunction with prime editing for some diseases, like particularly aggressive cancers, or in cases where medications help alleviate disease symptoms until the disease completely cured.

Below are examples of immunogenic epitopes that can by inserted by prime editing can be used to achieve:

| Vaccine | Disease | Epitope Amino Acid Sequence | Example Nucleic Acid Sequence (8) |
|---|---|---|---|
| 1 | Tetanus toxoid | QYIKANSKFIGITEL<br>(SEQ ID NO: 396) | CATGATATAAAAGCAAATTCTAAAT<br>TTATAGGTATAACTGAACTA<br>(SEQ ID NO: 397) |
| 2 | Diphtheria toxin mutant CRM197 | GADDVVDSSKSF<br>VMENFSSYHGTK<br>PGYVDSIQKGIQK<br>PKSGTQGNYDDD<br>WKEFYSTDNKYD<br>AAGYSVDNENPL<br>SGKAGGVVKVTY<br>PGLTKVLALKVD<br>NAETIKKELGLSL<br>TEPLMEQVGTEEF<br>IKRFGDGASRVVL<br>SLPFAEGSSSVEYI<br>NNWEQAKALSVE<br>LEINFETRGKRGQ<br>DAMYEYMAQAC<br>AGNRVRRSVGSS<br>LSCINLDWDVIRD<br>KTKTKIESLKEHG<br>PIKNKMSESPNKT<br>VSEEKAKQYLEEF<br>HQTALEHPELSEL<br>KTVTGTNPVFAG<br>ANYAAWAVNVA<br>QVIDSETADNLEK<br>TTAALSILPGIGSV<br>MGIADGAVHHNT<br>EEIVAQSIALSSL<br>MVAQAIPLVGEL<br>VDIGFAAYNFVES<br>IINLFQVVHNSYN<br>RPAYSPGHKTQPF<br>LHDGYAVSWNTV<br>EDSIIRTGFQGESG<br>HDIKITAENTPLPI<br>AGVLLPTIPGKLD<br>VNKSKTHISVNGR<br>KIRMRCRAIDGD<br>VTFCRPKSPVYVG<br>NGVHANLHVAFH<br>RSSSEKIHSNEISS<br>DSIGVLGYQKTV<br>DHTKVNSKLSLFF<br>EIKS<br>(SEQ ID NO: 630) | GGCGCCGACGACGTGGTGGACAGCA<br>GCAAGAGCTTCGTGATGGAGAACTT<br>CAGCAGCTACCACGGCACCAAGCCC<br>GGCTACGTGGACAGCATCCAGAAGG<br>GCATCCAGAAGCCCAAGAGCGGCAC<br>CCAGGGCAACTACGACGACGACTGG<br>AAGGAGTTCTACAGCACCGACAACA<br>AGTACGACGCCGCCGGCTACAGCGT<br>GGACAACGAGAACCCCCTGAGCGGC<br>AAGGCCGGCGGCGTGGTGAAGGTGA<br>CCTACCCCGGCCTGACCAAGGTGCT<br>GGCCCTGAAGGTGGACAACGCCGAG<br>ACCATCAAGAAGGAGCTGGGCCTGA<br>GCCTGACCGAGCCCCTGATGGAGCA<br>GGTGGGCACCGAGGAGTTCATCAAG<br>AGGTTCGGCGACGGCGCCAGCAGGG<br>TGGTGCTGAGCCTGCCCTTCGCCGA<br>GGGCAGCAGCAGCGTGGAGTACATC<br>AACAACTGGGAGCAGGCCAAGGCCC<br>TGAGCGTGGAGCTGGAGATCAACTT<br>CGAGACCAGGGGCAAGAGGGGCCA<br>GGACGCCATGTACGAGTACATGGCC<br>CAGGCCTGCGCCGGCAACAGGGTGA<br>GGAGGAGCGTGGGCAGCAGCCTGA<br>GCTGCATCAACCTGGACTGGGACGT<br>GATCAGGGACAAGACCAAGACCAA<br>GATCGAGAGCCTGAAGGAGCACGGC<br>CCCATCAAGAACAAGATGAGCGAGA<br>GCCCCAACAAGACCGTGAGCGAGGA<br>GAAGGCCAAGCAGTACCTGGAGGA<br>GTTCCACCAGACCGCCCTGGAGCAC<br>CCCGAGCTGAGCGAGCTGAAGACCG<br>TGACCGGCACCAACCCCGTGTTCGC<br>CGGCGCCAACTACGCCGCCTGGGCC<br>GTGAACGTGGCCCAGGTGATCGACA<br>GCGAGACCGCCGACAACCTGGAGAA<br>GACCACCGCCGCCCTGAGCATCCTG<br>CCCGGCATCGGCAGCGTGATGGGCA<br>TCGCCGACGGCGCCGTGCACCACAA<br>CACCGAGGAGATCGTGGCCCAGAGC<br>ATCGCCCTGAGCAGCCTGATGGTGG<br>CCCAGGCCATCCCCCTGGTGGGCGA<br>GCTGGTGGACATCGGCTTCGCCGCC<br>TACAACTTCGTGGAGAGCATCATCA<br>ACCTGTTCCAGGTGGTGCACAACAG<br>CTACAACAGGCCCGCCTACAGCCCC<br>GGCCACAAGACCCAGCCCTTCCTGC<br>ACGACGGCTACGCCGTGAGCTGGAA<br>CACCGTGGAGGACAGCATCATCAGG<br>ACCGGCTTCCAGGGCGAGAGCGGCC<br>ACGACATCAAGATCACCGCCGAGAA<br>CACCCCCCTGCCCATCGCCGGCGTG<br>CTGCTGCCCACCATCCCCGGCAAGC<br>TGGACGTGAACAAGAGCAAGACCCA<br>CATCAGCGTGAACGGCAGGAAGATC<br>AGGATGAGGTGCAGGGCCATCGACG<br>GCGACGTGACCTTCTGCAGGCCCAA<br>GAGCCCCGTGTACGTGGGCAACGGC<br>GTGCACGCCAACCTGCACGTGGCCT<br>TCCACAGGAGCAGCAGCGAGAAGAT<br>CCACAGCAACGAGATCAGCAGCGAC<br>AGCATCGGCGTGCTGGGCTACCAGA |

| Vaccine | Disease | Epitope Amino Acid Sequence | Example Nucleic Acid Sequence (8) |
|---|---|---|---|
| | | | AGACCGTGGACCACACCAAGGTGAA CAGCAAGCTGAGCCTGTTCTTCGAG (SEQ ID NO: 399) |
| 3 | mumps | ATCAAGAGC GTYRLIPNARANL TA (SEQ ID NO: 400) | GGCACCTACAGGCTGATCCCCAACG CCAGGGCCAACCTGACCGCC (SEQ ID NO: 401) |
| 4 | mumps | PSKFFTISDSATFA PGPVSNA (SEQ ID NO: 402) | Ccgagcaaattttttaccattagcg atagcgcgacctttgcgccgggccc ggtgagcaacgcg (SEQ ID NO: 403) |
| | | PSKLFIMLDNATF APGPVVNA (SEQ ID NO: 404) | Ccgagcaaactgtttattatgctg gataacgcgacctttgcgccgggc ccggtggtgaacgcg (SEQ ID NO: 405) |
| | | | Selected examples from Hemagglutinin-neuraminidase (HN) diversity among outbreak strains (table 1) Divergence between vaccine strain JL5 and outbreak strains (table2) |
| 5 | Rubella virus (RV) | TPPPYQVSCGGES DRASARVIDPAA QS (SEQ ID NO: 406) | ACCCCCCCCCCCTACCAGGTGAGCT GCGGCGGCGAGAGCGACAGGGCCA GCGCCAGGGTGATCGACCCCGCCGC CCAGAGC (SEQ ID NO: 407) |
| 6 | Hemagglutinin | PEYAYKIVKNKK MEDGFLQGMVD GWYGHHSNEQGS GLMENERTLDKA NPNNDLCSWSDH EASSNNTNQEDLL QRESRRKKRIGTS TLNQRGNCNTKC QTEEARLKREEVS LVKSDQCSNGSL QCRANNSTEQVD (SEQ ID NO: 408) | CCCGAGTACGCCTACAAGATCGTGA AGAACAAGAAGATGGAGGACGGCT TCCTGCAGGGCATGGTGGACGGCTG GTACGGCCACCACAGCAACGAGCAG GGCAGCGGCCTGATGGAGAACGAG AGGACCCTGGACAAGGCCAACCCCA ACAACGACCTGTGCAGCTGGAGCGA CCACGAGGCCAGCAGCAACAACACC AACCAGGAGGACCTGCTGCAGAGGG AGAGCAGGAGGAAGAAGAGGATCG GCACCAGCACCCTGAACCAGAGGGG CAACTGCAACACCAAGTGCCAGACC GAGGAGGCCAGGCTGAAGAGGGAG GAGGTGAGCCTGGTGAAGAGCGACC AGTGCAGCAACGGCAGCCTGCAGTG CAGGGCCAACAACAGCACCGAGCA GGTGGAC (SEQ ID NO: 409) |
| 7 | Neuraminidase | TKSTNSRSGGISG PDNEAPVGEAPSP YGDNPRPNDGNN IRIGSKGYNGIITD TIEESCSCYPDAK VVKSVELDSTIWT SGSSPNQKIITIGW DPNGWTGTPMSP NGAYGTDGPSNG QANQHQAESISA GNSSLCPIRDNWH GSNRSWSWPDGAE (SEQ ID NO: 410) | ACCAAGAGCACCAACAGCAGGAGC GGCGGCATCAGCGGCCCCGACAACG AGGCCCCCGTGGGCGAGGCCCCCAG CCCCTACGGCGACAACCCCAGGCCC AACGACGGCAACAACATCAGGATCG GCAGCAAGGGCTACAACGGCATCAT CACCGACACCATCGAGGAGAGCTGC AGCTGCTACCCCGACGCCAAGGTGG TGAAGAGCGTGGAGCTGGACAGCAC CATCTGGACCAGCGGCAGCAGCCCC AACCAGAAGATCATCACCATCGGCT GGGACCCCAACGGCTGGACCGGCAC CCCCATGAGCCCCAACGGCGCCTAC GGCACCGACGGCCCCAGCAACGGCC AGGCCAA.CCAGCACCAGGCCGAGA GCATCAGCGCCGGCAACAGCAGCCT GTGCCCCATCAGGGACAACTGGCAC GGCAGCAACAGGAGCTGGAGCTGGC CCGACGGCGCCGAG (SEQ ID NO: 411) |
| 8 | TAP (transport antigen presentation) on H5N1 virus hemagglutinin | EKIVLLLAMMEKI VLLLAKCQTPMG AIKAVDGVTNKC PYLGSPSF (SEQ ID NO: 412) | GAGAAGATCGTGCTGCTGCTGGCCA TGATGGAGAAGATCGTGCTGCTGCT GGCCAAGTGCCAGACCCCCATGGGC GCCATCAAGGCCGTGGACGGCGTGA CCAACAAGTGCCCCTACCTGGGCAG CCCCAGCTTC (SEQ ID NO: 413) |

| Vaccine | Disease | Epitope Amino Acid Sequence | Example Nucleic Acid Sequence (8) |
|---|---|---|---|
| 9 | TAP (transport antigen presentation) on h5n1 virus neuraminidase | IRPCFWVELNPNQ KIITIRPCFWVELI CYPDAGEIT(SEQ ID NO: 414) AGATCACC | ATCAGGCCCTGCTTCTGGGTGGAGC TGAACCCCAACCAGAAGATCATCAC CATCAGGCCCTGCTTCTGGGTGGAG CTGATCTGCTACCCCGACGCCGGCG (SEQ ID NO: 415) |
| 10 | hemagglutinin epitopes toward class I HLA | MEKIVLLLAEKIV LLLAMCPYLGSPS FKCQTPMGAIKA VDGVTNK (SEQ ID NO: 416) | ATGGAGAAGATCGTGCTGCTGCTGG CCGAGAAGATCGTGCTGCTGCTGGC CATGTGCCCCTACCTGGGCAGCCCC AGCTIVAAGTGCCAGACCCCCATGG GCGCCATCAAGGCCGTGGACGGCGT GACCAACAAG(SEQ ID NO: 417) |
| 11 | neuraminidase epitopes toward class I HLA | NPNQMITICYPDAG EITIRPCFWVELRPC FWVELI (SEQ ID NO: 418) | AACCCCAACCAGAAGATCATCACCAT CTGCTACCCCGACGCCGGCGAGATCA CCATCAGGCCCTGCTTCTGGGTGGAG CTGAGGCCCTGCTTCTGGGTGGAGCT GATC (SEQ ID NO: 419) |
| 12 | hemagglutinin epitopes toward class II HLA | MVSLVKSDQIGTST LNQR (SEQ ID NO: 420) | ATGGTGAGCCTGGTGAAGAGCGACCA GATCGGCACCAGCACCCTGAACCAGA GG (SEQ ID NO: 421) |
| 13 | neuraminidase epitopes toward class II HLA | YNGIITDTI (SEQ ID NO: 422) | TACAACGGCATCATCACCGACACCATC (SEQ ID NO: 423) |
| 14 | hemagglutinin epitope H5N1-bound class I and class II HLA | MEKIVLLLAEKIVL LLAMMVSLVKSDQ CPYLGSPSFIGTSTL NQRKCQTPMGAIK AVDGVTNK (SEQ ID NO: 424) | ATGGAGAAGATCGTGCTGCTGCTGGC CGAGAAGATCGTGCTGCTGCTGGCCA TGATGGTGAGCCTGTGAAGAGCGAC CAGTGCCCCTACCTGGGCAGCCCCAG CTTCATCGGCACCAGCACCCTGAACC AGAGG (SEQ ID NO: 425) |
| 15 | neuraminidase epitope H5N1-bound class I and class II HLA | NPNQKIITIYNGIIT DTICYPDAGEITIRP CFWVELRPCFWVE LI (SEQ ID NO: 426) | AACCCCAACCAGAAGATCATCACCAT CTACAACGGCATCATCACCGACACCA TCTGCTACCCCGACGCCGGCGAGATC ACCATCAGGCCCTGCTTCTGGGTGGA GCTGAGGCCCTGCTTCTGGGTGGAGC TGATC (SEQ ID NO: 427) |

Below are additional examples of epitopes that may be integrated into a target gene for immunoepitope taggin:

References Cited in Example 8

The following references are incorporated by reference in their entireties.
1. X. Wen, K. Wen, D. Cao, G. Li, R. W. Jones, J. Li, S. Szu, Y. Hoshino, L. Yuan, Inclusion of a universal tetanus toxoid CD4(+) T cell epitope P2 significantly enhanced the immunogenicity of recombinant rotavirus ΔVP8* subunit parenteral vaccines. Vaccine 32, 4420-4427 (2014).
2. G. Ada, D. Isaacs, Carbohydrate-protein conjugate vaccines. Clin Microbiol Infect 9, 79-85 (2003).
3. E. Malito, B. Bursulaya, C. Chen, P. L. Surdo, M. Picchianti, E. Balducci, M. Biancucci, A. Brock, F. Berti, M. J. Bottomley, M. Nissum, P. Costantino, R. Rappuoli, G. Spraggon, Structural basis for lack of toxicity of the diphtheria toxin mutant CRM197. Proceedings of the National Academy of Sciences 109, 5229 (2012).
4. J. de Wit, M. E. Emmelot, M. C. M. Poelen, J. Lanfermeijer, W. G. H. Han, C. van Els, P. Kaaijk, The Human CD4(+) T Cell Response against Mumps Virus Targets a Broadly Recognized Nucleoprotein Epitope. J Virol 93, (2019).
5. M. May, C. A. Rieder, R. J. Rowe, Emergent lineages of mumps virus suggest the need for a polyvalent vaccine. Int J Infect Dis 66, 1-4 (2018).
6. M. Ramamurthy, P. Rajendiran, N. Saravanan, S. Sankar, S. Gopalan, B. Nandagopal, Identification of immunogenic B-cell epitope peptides of rubella virus E1 glycoprotein towards development of highly specific immunoassays and/or vaccine. Conference Abstract, (2019).
7. U. S. F. Tambunan, F. R. P. Sipahutar, A. A. Parikesit, D. Kerami, Vaccine Design for H5N1 Based on B- and T-cell Epitope Predictions. Bioinform Biol Insights 10, 27-35 (2016).

Example 9—In Vivo Delivery of PE Agents

Precise genome targeting technologies using the CRISPR/Cas9 system have recently been explored in a wide range of applications, including gene therapy. A major limitation to the application of Cas9 and Cas9-based genome-editing agents in gene therapy is the size of Cas9 (>4 kb), impeding its efficient delivery via recombinant adeno-associated virus (rAAV). Recently-developed fusions of Cas9 to reverse transcriptases ("Prime editors") represent a novel genome editing technology that possesses a number of advantages over existing genome editing methods, including the ability to install any single nucleotide substitution, and to insert or delete any arbitrarily-defined short (<~20) stretch of nucleotides in a site-specific manner. As such, this method enables editing of human pathogenic variants that have been intractable to correction previously. The delivery of prime editing reagents could enable correction of genetic sequences that cause human disease, or allow for the installation of disease-preventing gene variants.

This invention describes methods for delivering prime editors into cells in vitro and in vivo. Prime editors have been developed and characterized solely in cultured cells. No known method can deliver prime editors in vivo. The presently disclosed methods for delivering prime editors via rAAV or pre-assembled ribonucleoprotein (RNP) complexes will overcome several barriers to in vivo delivery. For example, the DNA encoding prime editors is larger than the rAAV packaging limit, and so requires special solutions. One such solution is formulating the editor fused to split intein pairs that are packaged into two separate rAAV particles that, when co-delivered to a cell, reconstitute the functional editor protein. Several other special considerations to account for the unique features of prime editing are described, including the optimization of second-site nicking targets and properly packaging prime editors into virus vectors, including lentiviruses and rAAV.

Distinguishing features include using ribonucleoprotein (RNP) delivery formulations, prime editors and nearby nicking targets can be pre-complexed with their specific sgRNA/PEgRNA. This will enhance the range of possible targetable sites and allow for greater optimization of editing efficiency relative to current data that has used DNA delivery. Using either RNP or mRNA delivery formulations, variant Cas proteins can be used that each complex with their own guide RNA variant. This will also allow for a greater diversity of potential nicking loci, so it is expected that optimization can be achieved for greater efficiency in any given application. Using RNP, it is expected to increase editing specificity base on previous RNP reports (Rees et al., 2017). This would reduce off-target prime editing. Potential architectures for splitting prime editors into two AAV vectors for delivery in vivo or ex vivo are described. Packaging prime editor into a dual AAV system requires optimization of design considerations including split sites, reconstitution methods (such as inteins), and guide expression architecture. Using a mixture of virus and RNP for delivery of prime editor, it is expected that editing will be controlled over time since RNP eventually degrades in vivo which will stop prime editing after RNP is no longer supplied.

Prime editor ribonucleoprotein (RNP), mRNA with prime editor guide RNA, or DNA can be packaged into lipid nanoparticles, rAAV, or lentivirus and injected, ingested, or inhaled to alter genomic DNA in vivo and ex vivo, including for the purposes of establishing animal models of human disease, testing therapeutic and scientific hypotheses in animal models of human disease, and treating disease in humans.

Prime editors could feasibly be used to correct a large fraction of all genetic diseases (~89% of pathogenic human genetic variants in Clinvar), if suitable means of delivery into relevant cell types in vivo are developed. Blood diseases, retinal diseases, and liver diseases are the most likely first applications due to established delivery systems for other reagents. AAV capsids, other evolved or engineered viral vectors, and lipid nanoparticle formulations would need to be used in combination with this invention.

In certain embodiments, one or more of the prime editor domains (e.g., the napDNAbp domain or the RT domain) could be engineered with an intein sequence.

Example 10—Use of PE to Identify Off-Target Editing

There are currently no described methods to detect off-target editing with prime editors (prime editing itself has not been published yet). These methods would allow a researcher to identify potential sites of off-target editing using prime editors, which would be important considerations were this technique used to treat genetic disease in patients.

Methods described here could also be useful to identify off-targets of Cas nucleases. These off-targets have previously been identified using BLESS, Guide-Seq, CIRCLE-Seq, and Digenome-Seq. However, this method is advantageous in the sensitivity and simplicity of the process.

The key concept of this aspect is the idea of using prime editing to insert an adapter sequence or primer binding site, templated from a PEgRNA, to enable the rapid identification of genomic off-target modification sites of Cas nucleases or prime editors.

No method to identify in an unbiased manner prime editing off-target sites is known. This method is distinguished from other techniques that identify nuclease off-target sites because the adapter sequence is inserted in the same event as DNA binding and nicking, simplifying the downstream processing.

The present invention includes identification of off-target editing sites when editing inside a living cell, in tissue culture or animal models (see FIG. 33). To conduct this method, a PEgRNA is generated that has an identical protospacer to the final desired editor (and, if looking at prime editing off-targets, an identical primer-binding site sequence to the final desired editor), but includes the necessary sequences to install an adapter or primer binding site after reverse transcription by prime editing. In vivo editing is conducted using a prime editor or RT-fused nuclease, and isolate genomic DNA. The genomic DNA is fragmented by enzymatic or mechanical means and append a different adapter to sites of DNA fragmentation. PCR is used to amplify from one adapter to the adapter installed via PEgRNA. The resulting product is deep-sequenced to identify all modified sites.

The invention also includes identification of off-target editing sites using in vitro modification of genomic DNA (see FIG. 33). To conduct this method, RNP of purified prime editor protein and a PEgRNA is assembled that will install an adapter or primer binding sequence, but is otherwise the same as the PEgRNA of interest. This RNP is incubated with extracted genomic DNA before or after fragmentation of the DNA and attachment of different adapters to sites of DNA breaks. PCR is used to amplify from fragmented site to the adapter that was installed with PE. Deep sequence to identify sites of modification. This in vitro editing method should enhance the sensitivity of detection, because cellular DNA repair will never eliminate the reverse-transcribed DNA adapter added by the prime editor.

These methods could be used to identify off-target editing for any prime editor, or any genome editor that uses a guideRNA to recognize a target cut site (most Cas nucleases).

Example 11—Use of PE to Enable Chemical-Induced Dimerization of Target Proteins In Vivo The prime editors described herein may also be used to place dimerization-induced biological processes, such as receptor signaling, under control of a convenient small-molecule drug by the genomic integration of genes encoding small-molecule binding proteins with prime editing is described herein. Using the prime editors described herein, the gene sequence encoding a small-molecule binding protein may be inserted within a gene encoding a target protein of interest in a living cell or patient. This edit alone should have no physiological effect. Upon administration of the small-molecule drug, which typically is a dimeric small molecule that can simultaneously bind to two drug-binding protein domains each of which is fused to a copy of the target protein, the small-molecule induces dimerization of the targeted protein. This target protein dimerization event then induces a biological signaling event, such as erythropoiesis or insulin signaling.

Example 12—Prime Editing: Highly Versatile and Precise Search-and-Replace Genome Editing in Human Cells without Double-Stranded DNA Breaks Current genome editing methods can disrupt, delete, or insert target genes with accompanying byproducts of double-stranded DNA breaks using programmable nucleases, and install the four transition point mutations at target loci using base editors. Small insertions, small deletions, and the eight transversion point mutations, however, collectively represent most pathogenic genetic variants but cannot be corrected efficiently and without an excess of byproducts in most cell types. Described herein is prime editing, a highly versatile and precise genome editing method that directly writes new genetic information into a specified DNA site using a catalytically impaired Cas9 fused to an engineered reverse transcriptase, programmed with an engineered prime editing guide RNA (PEgRNA) that both specifies the target site and encodes the desired edit. Greater than 175 distinct edits in human cells were performed to establish that prime editing can make targeted insertions, deletions, all 12 possible types of point mutations, and combinations thereof efficiently (typically 20-60%, up to 77% in unsorted cells) and with low byproducts (typically 1-10%), without requiring double-stranded breaks or donor DNA templates. Prime editing was applied in human cells to correct the primary genetic causes of sickle cell disease (requiring an A.T-to-T.A transversion in HBB) and Tay-Sachs disease (requiring a 4-base deletion in HEXA), in both cases efficiently reverting the pathogenic genomic alleles to wild-type with minimal byproducts. Prime editing was also used to create human cell lines with these pathogenic HBB transversion and HEXA insertion mutations, to install the G127V mutation in PRNP that confers resistance to prion disease (requiring a G.C-to-T.A transversion), and to efficiently insert a His6 tag, a FLAG epitope tag, and an extended LoxP site into target loci in human cells. Prime editing offers efficiency and product purity advantages over HDR, and complementary strengths and weaknesses compared to base editing. Consistent with its search-and-replace mechanism, which requires three distinct base-pairing events, prime editing is much less prone to off-target DNA modification at known Cas9 off-target sites than Cas9. Prime editing substantially expands the scope and capabilities of genome editing, and in principle can correct ~89% of known pathogenic human genetic variants.

The ability to make virtually any targeted change in the genome of any living cell or organism is a longstanding aspiration of the life sciences. Despite rapid advances in genome editing technologies, the majority of the >75,000 known human genetic variants associated with diseases[111] cannot be corrected or installed in most therapeutically relevant cells (FIG. 38A). Programmable nucleases such as CRISPR-Cas9 make double-stranded DNA breaks (DSBs) that can disrupt genes by inducing mixtures of insertions and deletions (indels) at target sites[112-114]. Nucleases can also be used to delete target genes[115,116], or insert exogenous genes[117-119], through homology-independent processes. Double-stranded DNA breaks, however, are also associated with undesired outcomes including complex mixtures of products, translocations[120], and p53 activation[121,122]. Moreover, the vast majority of pathogenic alleles differ from their non-pathogenic counterparts by small insertions, deletions, or base substitutions that require much more precise editing technologies to correct (FIG. 38A). Homology-directed repair (HDR) stimulated by nuclease-induced DSBs[123] has been widely used to install a variety of precise DNA changes. HDR, however, relies on exogenous donor DNA repair templates, typically generates an excess of indel byproducts from end-joining repair of DSBs, and is inefficient in most therapeutically relevant cell types (T cells and some stem cells being important exceptions)[124,125]. While enhancing the efficiency and precision of DSB-mediated genome editing remains the focus of promising efforts[126-130], these challenges necessitate the exploration of alternative precision genome editing strategies.

Base editing can efficiently install or correct the four types of transition mutations (C to T, G to A, A to G, and T to C) without requiring DSBs in a wide variety of cell types and organisms, including mammals[128-131], but cannot currently achieve any of the eight transversion mutations (C to A, C to G, G to C, G to T, A to C, A to T, T to A, and T to G), such as the T.A-to-A.T mutation needed to directly correct the most common cause of sickle cell disease (HBB E6V)[132]. In addition, no DSB-free method has been reported to perform target deletions, such as the removal of the 4-base duplication that causes Tay-Sachs disease (HEXA 1278+TATC)[133], or targeted insertions, such as the precise 3-base insertion required to directly correct the most common cause of cystic fibrosis (CFTR ΔF508)[134]. Targeted transversion point mutations, insertions, and deletions thus are difficult to install or correct efficiently and without excess byproducts in most cell types, even though they collectively account for most known pathogenic alleles (FIG. 38A).

Described herein is the development of prime editing, a new "search-and-replace" genome editing technology that mediates targeted insertions, deletions, and all 12 possible base-to-base conversions at targeted loci in human cells without requiring double-stranded DNA breaks, or donor DNA templates. Prime editors, initially exemplified by PE1, use a reverse transcriptase fused to a programmable nickase and a prime editing extended guide RNA (PEgRNA) to directly copy genetic information from the extension on the PEgRNA into the target genomic locus. A second-generation prime editor (PE2) uses an engineered reverse transcriptase to substantially increase editing efficiencies with minimal (typically <2%) indel formation, while a third-generation PE3 system adds a second guide RNA to nick the non-edited strand, thereby favoring replacement of the non-edited strand and further increasing editing efficiency, typically, to about 20-50% in human cells with about 1-10% indel formation. PE3 offers far fewer byproducts and higher or similar efficiency compared to optimized Cas9 nuclease-initiated HDR, and offers complementary strengths and weaknesses compared to current-generation base editors.

PE3 was applied at genomic loci in human HEK293T cells to achieve efficient conversion of HBB E6V to wild-type HBB, deletion of the inserted TATC to restore HEXA 1278+TATC to wild-type HEXA, installation in PRNP of the G127V mutation that confers resistance to prion disease[135] (requiring a G.C-to-T.A transversion), and targeted insertion of a His6 tag (18 bp), FLAG epitope tag (24 bp), and extended LoxP site for Cre-mediated recombination (44 bp). Prime editing was also successful in three other human cell lines, as well as in post-mitotic primary mouse cortical neurons, with varying efficiencies. Due to a high degree of flexibility in the distance between the initial nick and location of the edit, prime editing is not substantially constrained by the PAM requirement of Cas9 and in principle can target the vast majority of genomic loci. Off-target prime editing is much rarer than off-target Cas9 editing at known Cas9 off-target loci, likely due to the requirement of three distinct DNA base pairing events in order for productive prime editing to take place. By enabling precise targeted insertions, deletions, and all 12 possible classes of point mutations at a wide variety of genomic loci without the need for DSBs or donor DNA templates, prime editing has the potential to advance the study and correction of many gene variants.

Results

Strategy for Transferring Information from an Extended Guide RNA into a Target DNA Locus Cas9 targets DNA using a guide RNA containing a spacer sequence that hybridizes to the target DNA site[112-114,136,137]. The aim was to engineer guide RNAs to both specify the DNA target as in natural CRISPR systems[138,139], and also to contain new genetic information that replaces the corresponding DNA nucleotides at the target locus. The direct transfer of genetic information from an extended guide RNA into a specified DNA site, followed by replacement of the original unedited DNA, in principle could provide a general means of installing targeted DNA sequence changes in living cells, without dependence on DSBs or donor DNA templates. To achieve this direct information transfer, the aim was to use genomic DNA, nicked at the target site to expose a 3'-hydroxyl group, to prime the reverse transcription of the genetic information from an extension on the engineered guide RNA (hereafter referred to as the prime editing guide RNA, or PEgRNA) directly into the target site (FIG. 38A).

These initial steps of nicking and reverse transcription, which resemble mechanisms used by some natural mobile genetic elements[140], result in a branched intermediate with two redundant single-stranded DNA flaps on one strand: a 5' flap that contains the unedited DNA sequence, and a 3' flap that contains the edited sequence copied from the PEgRNA (FIG. 38B). To achieve a successful edit, this branched intermediate must be resolved so that the edited 3' flap replaces the unedited 5' flap. While hybridization of the 5' flap with the unedited strand is likely to be thermodynamically favored since the edited 3' flap can make fewer base pairs with the unedited strand, 5' flaps are the preferred substrate for structure-specific endonucleases such as FEN1[141], which excises 5' flaps generated during lagging-strand DNA synthesis and long-patch base excision repair. It was reasoned that preferential 5' flap excision and 3' flap ligation could drive the incorporation of the edited DNA strand, creating heteroduplex DNA containing one edited strand and one unedited strand (FIG. 38B).

Permanent installation of the edit could arise from subsequent DNA repair that resolves the mismatch between the two DNA strands in a manner that copies the information in the edited strand to the complementary DNA strand (FIG. 38C). Based on a similar strategy developed to maximize the efficiency of DNA base editing[131-133], it was envisioned that nicking the non-edited DNA strand, far enough from the site of the initial nick to minimize double-strand break formation, might bias DNA repair to preferentially replace the non-edited strand.

Validation of Prime Editing Steps In Vitro and in Yeast Cells

Following cleavage of the PAM-containing DNA strand by the RuvC nuclease domain of Cas9, the PAM-distal fragment of this strand can dissociate from otherwise stable Cas9:sgRNA:DNA complexes[143]. It was hypothesized that the 3' end of this liberated strand might be sufficiently accessible to prime DNA polymerization. Guide RNA engineering efforts[144-146] and crystal structures of Cas9:sgRNA:DNA complexes[147-149] suggest that the 5' and 3' termini of the sgRNA can be extended without abolishing Cas9:sgRNA activity. PEgRNAs were designed by extending sgRNAs to include two critical components: a primer binding site (PBS) that allows the 3' end of the nicked DNA strand to hybridize to the PEgRNA, and a reverse transcriptase (RT) template containing the desired edit that would be directly copied into the genomic DNA site as the 3' end of the nicked DNA strand is extended across the RNA template by a polymerase (FIG. 38C).

These hypotheses were tested in vitro using purified *S. pyogenes* Cas9 protein. A series of PEgRNA candidates were constructed by extending sgRNAs on either terminus with a PBS sequence (5 to 6 nucleotides, nt) and an RT template (7 to 22 nt). It was confirmed that 5'-extended PEgRNAs direct Cas9 binding to target DNA, and that both 5'-extended PEgRNAs and 3'-extended PEgRNAs support Cas9-mediated target nicking in vitro and DNA cleavage activities in mammalian cells (FIGS. 44A-44C). These candidate PEgRNA designs were tested using pre-nicked 5'-Cy5-labeled dsDNA substrates, catalytically dead Cas9 (dCas9), and a commercial variant of Moloney murine leukemia virus (M-MLV) reverse transcriptase (FIG. 44D). When all components were present, efficient conversion of the fluorescently labeled DNA strand into longer DNA products with gel mobilities, consistent with reverse transcription along the RT template, (FIG. 38D, FIGS. 44D-44E) was observed. Products of desired length were formed with either 5'-extended or 3'-extended PEgRNAs (FIGS. 38D-38E). Omission of dCas9 led to nick translation products derived from reverse transcriptase-mediated DNA polymerization on the DNA template, with no PEgRNA information transfer (FIG. 38D). No DNA polymerization products were observed when the PEgRNA was replaced by a conventional sgRNA, confirming the necessity of the PBS and RT template components of the PEgRNA (FIG. 38D). These results demonstrate that Cas9-mediated DNA melting exposes a single-stranded R-loop that, if nicked, is competent to prime reverse transcription from either a 5'-extended or 3'-extended PEgRNA.

Next, non-nicked dsDNA substrates were tested with a Cas9 nickase (H840A mutant) that exclusively nicks the PAM-containing strand[112]. In these reactions, 5'-extended PEgRNAs generated reverse transcription products inefficiently, possibly due to impaired Cas9 nickase activity (FIG. 44F). However, 3'-extended PEgRNAs enabled robust Cas9 nicking and efficient reverse transcription (FIG. 38E). The use of 3'-extended PEgRNAs generated only a single apparent product, despite the potential, in principle, for reverse transcription to terminate anywhere within the remainder of the PEgRNA. DNA sequencing of the products of reactions with Cas9 nickase, RT, and 3'-extended PEgRNAs revealed that the complete RT template sequence was reverse transcribed into the DNA substrate (FIG. 44G). These experiments established that 3'-extended PEgRNAs can template the reverse transcription of new DNA strands while retaining the ability to direct Cas9 nickase activity.

To evaluate the eukaryotic cell DNA repair outcomes of 3' flaps produced by PEgRNA-programmed reverse transcription in vitro, DNA nicking and reverse transcription using PEgRNAs, Cas9 nickase, and RT in vitro on reporter plasmid substrates were performed, and the reaction products were then transformed into yeast (*S. cerevisiae*) cells (FIG. 45A). Encouragingly, when plasmids were edited in vitro with 3'-extended PEgRNAs encoding a T.A-to-A.T transversion that corrects the premature stop codon, 37% of yeast transformants expressed both GFP and mCherry proteins (FIG. 38F, FIG. 45C). Consistent with the results in FIG. 38E and FIG. 44F, editing reactions carried out in vitro with 5'-extended PEgRNAs yielded fewer GFP and mCherry double-positive colonies (9%) than those with 3'-extended PEgRNAs (FIG. 38F and FIG. 45D). Productive editing was also observed using 3'-extended PEgRNAs that insert a single nucleotide (15% double-positive transformants) or delete a single nucleotide (29% double-positive transformants) to correct frameshift mutations (FIG. 38F and FIGS. 45E-45F). DNA sequencing of edited plasmids recovered from double-positive yeast colonies confirmed that the encoded transversion edit occurred at the desired sequence position (FIG. 45G). These results demonstrate that DNA repair in eukaryotic cells can resolve 3' DNA flaps arising from prime editing to incorporate precise DNA edits including transversions, insertions, and deletions.

Design of Prime Editor 1 (PE1)

Encouraged by the results in vitro and in yeast, a prime editing system with a minimum number of components capable of editing genomic DNA in mammalian cells was sought for development. It was hypothesized that 3'-extended PEgRNAs (hereafter referred to simply as PEgRNAs, FIG. 39A) and direct fusions of Cas9 H840A to reverse transcriptase via a flexible linker may constitute a functional two-component prime editing system. HEK293T (immortalized human embryonic kidney) cells were transfected with one plasmid encoding a fusion of wild-type M-MLV reverse transcriptase to either terminus of Cas9 H840A nickase as well as a second plasmid encoding a PEgRNA. Initial attempts led to no detectable T.A-to-A.T conversion at the HEK3 target locus.

Extension of the PBS in the PEgRNA to 8-15 bases (FIG. 39A), however, led to detectable T.A-to-A.T editing at the HEK3 target site (FIG. 39B), with higher efficiencies for prime editor constructs in which the RT was fused to the C-terminus of Cas9 nickase (3.7% maximal T.A-to-A.T conversion with PBS lengths ranging from 8-15 nt) compared to N-terminal RT-Cas9 nickase fusions (1.3% maximal T.A-to-A.T conversion) (FIG. 39B; all mammalian cell data herein reports values for the entire treated cell population, without selection or sorting, unless otherwise specified). These results suggest that wild-type M-MLV RT fused to Cas9 requires longer PBS sequences for genome editing in human cells compared to what is required in vitro using the commercial variant of M-MLV RT supplied in trans. This first-generation wild-type M-MLV reverse transcriptase fused to the C-terminus of Cas9 H840A nickase was designated as PE1.

The ability of PE1 to precisely introduce transversion point mutations at four additional genomic target sites specified by the PEgRNA (FIG. 39C) was tested. Similar to editing at the HEK3 locus, efficiency at these genomic sites was dependent on PBS length, with maximal editing efficiencies ranging from 0.7-5.5% (FIG. 39C). Indels from PE1 were low, averaging 0.2±0.1% for the five sites under conditions that maximized each site's editing efficiency (FIG. 46A). PE1 was also able to install targeted insertions and deletions, exemplified by a single-nucleotide deletion (4.0% efficiency), a single-nucleotide insertion (9.7%), and a three-nucleotide insertion (17%) at the HEK3 locus (FIG. 39C). These results establish the ability of PE1 to directly install targeted transversions, insertions, and deletions without requiring double-stranded DNA breaks or DNA templates.

Design of Prime Editor 2 (PE2)

While PE1 can install a variety of edits at several loci in HEK293T cells, editing efficiencies were generally low (typically ≤5%) (FIG. 39C). It was hypothesized that engineering the reverse transcriptase in PE1 might improve the efficiency of DNA synthesis within the unique conformational constraints of the prime editing complex, resulting in higher genome editing yields. M-MLV RT mutations have been previously reported that increase enzyme thermostability[150,151], processivity[150], and DNA:RNA heteroduplex substrate affinity[152], and that inactivate RNaseH activity[153]. 19 PE1 variants were constructed containing a variety of reverse transcriptase mutations to evaluate their prime editing efficiency in human cells.

First, a series of M-MLV RT variants that previously emerged from laboratory evolution for their ability to support reverse transcription at elevated temperatures[150] were investigated. Successive introduction of three of these amino acid substitutions (D200N, L603W, and T330P) into M-MLV RT, hereafter referred to as M3, led to a 6.8-fold average increase in transversion and insertion editing efficiency across five genomic loci in HEK293T cells compared to that of PE1 (FIGS. 47A-47S).

Next, in combination with M3, additional reverse transcriptase mutations that were previously shown to enhance binding to template:PBS complex, enzyme processivity, and thermostability[152] were tested. Among the 14 additional mutants analyzed, a variant with T306K and W313F substitutions, in addition to the M3 mutations, improved editing efficiency an additional 1.3-fold to 3.0-fold compared to M3 for six transversion or insertion edits across five genomic sites in human cells (FIGS. 47A-47S). This pentamutant of M-MLV reverse transcriptase incorporated into the PE1 architecture (Cas9 H840A-M-MLV RT (D200N L603W T330P T306K W313F)) is hereafter referred to as PE2.

PE2 installs single-nucleotide transversion, insertion, and deletion mutations with substantially higher efficiency than PE1 (FIG. 39C), and is compatible with shorter PBS PEgRNA sequences (FIG. 39C), consistent with an enhanced ability to productively engage transient genomic DNA:PBS complexes. On average, PE2 led to a 1.6- to 5.1-fold improvement in prime editing point mutation efficiency over PE1 (FIG. 39C), and in some cases dramatically improved editing yields up to 46-fold (FIG. 47F and FIG. 47I). PE2 also effected targeted insertions and deletions more efficiently than PE1, achieving the targeted insertion of the 24-bp FLAG epitope tag at the HEK3 locus with 4.5% efficiency, a 15-fold improvement over the efficiency of installing this insertion with PE1 (FIG. 47D), and mediated a 1-bp deletion in HEK3 with 8.6% efficiency, 2.1-fold higher than that of PE1 (FIG. 39C). These results establish PE2 as a more efficient prime editor than PE1.

Optimization of PEgRNA Features

The relationship between PEgRNA architecture and prime editing efficiency was systematically probed at five genomic loci in HEK293T cells with PE2 (FIG. 39C). In general, priming sites with lower GC content required longer PBS sequences (EMX1 and RNF2, containing 40% and 30% GC content, respectively, in the first 10 nt upstream of the nick), whereas those with greater GC content supported prime editing with shorter PBS sequences (HEK4 and FANCF, containing 80% and 60% GC content, respectively, in the first 10 nt upstream of the nick) (FIG. 39C), consistent with the energetic requirements for hybridization of the nicked DNA strand to the PEgRNA PBS. No PBS length or GC content level was strictly predictive of prime editing efficiency, and other factors such as secondary structure in the DNA primer or PEgRNA extension may also influence editing activity. It is recommended to start with a PBS length of ~13 nt for a typical target sequence, and exploring different PBS lengths if the sequence deviates from ~40-60% GC content. When necessary, optimal PBS sequences should be determined empirically.

Next, the performance determinants of the RT template portion of the PEgRNA were studied. PEgRNAs with RT templates ranging from 10-20 nt in length were systemically evaluated at five genomic target sites using PE2 (FIG. 39D) and with longer RT templates as long as 31 nt at three genomic sites (FIGS. 48A-48C). As with PBS length, RT template length also could be varied to maximize prime editing efficiency, although in general many RT template lengths ≥10 nt long support more efficient prime editing (FIG. 39D). Since some target sites preferred longer RT templates (≥15 nt) to achieve higher editing efficiencies (FANCF, EMX1), while other loci preferred short RT templates (HEK3, HEK4) (FIG. 39D), it is recommend both short and long RT templates be tested when optimizing a PEgRNA, starting with ~10-16 nt.

Importantly, RT templates that place a C as the nucleotide adjacent to the terminal hairpin of the sgRNA scaffold generally resulted in lower editing efficiency compared to other PEgRNAs with RT templates of similar length (FIGS. 48A-48C). Based on the structure of sgRNAs bound to Cas9[148,149], it was speculated that the presence of a C as the first nucleotide of the 3' extension of a canonical sgRNA can disrupt the sgRNA scaffold fold by pairing with G81, a nucleotide that natively forms a pi stack with Tyr 1356 in Cas9 and a non-canonical base pair with sgRNA A68. Since many RT template lengths support prime editing, it is recommended to choose PEgRNAs in which the first base of the 3' extension (the last reverse-transcribed base of the RT template) is not C.

Design of Prime Editor 3 Systems (PE3 and PE3b)

While PE2 can transfer genetic information from the PEgRNA to the target locus more efficiently than PE1, the manner in which the cell resolves the resulting heteroduplex DNA created by one edited strand and one unedited strand determines if the edit is durable. A previous development of base editing faced a similar challenge since the initial product of cytosine or adenine deamination is heteroduplex DNA containing one edited and one non-edited strand. To increase the efficiency of base editing, a Cas9 D10A nickase was used to introduce a nick into the non-edited strand and to direct DNA repair to that strand, using the edited strand as a template[129,130,142]. To exploit this principle to enhance prime editing efficiencies, a similar strategy of nicking the non-edited strand using the Cas9 H840A nickase already present in PE2 and a simple sgRNA to induce preferential replacement of the non-edited strand by the cell (FIG. 40A) was tested. Since the edited DNA strand was also nicked to initiate prime editing, a variety of sgRNA-programmed nick locations were tested on the non-edited strand to minimize the production of double-stranded DNA breaks that lead to indels.

This PE3 strategy was first tested at five genomic sites in HEK293T cells by screening sgRNAs that induce nicks located 14 to 116 bases from the site of the PEgRNA-induced nick, either 5' or 3' of the PAM. In four of the five sites tested, nicking the non-edited strand increased the amount of indel-free prime editing products compared to the PE2 system by 1.5- to 4.2-fold, to as high as 55% (FIG. 40B). While the optimal nicking position varied depending on the genomic site, nicks positioned 3' of the PAM (positive distances in FIG. 40B) approximately 40-90 bp from the PEgRNA-induced nick generally produced favorable increases in prime editing efficiency (averaging 41%) without excess indel formation (6.8% average indels for the sgRNA resulting in the highest editing efficiency for each of the five sites tested) (FIG. 40B). As expected, at some sites, placement of the non-edited strand nick within 40 bp of the PEgRNA-induced nick led to large increases in indel formation up to 22% (FIG. 40B), presumably due to the formation of a double-strand break from nicking both strands close together. At other sites, however, nicking as close as 14 bp away from the PEgRNA-induced nick produced only 5% indels (FIG. 40B), suggesting that locus-dependent factors control conversion of proximal dual nicks into double-strand DNA breaks. At one tested site (HEK4), complementary strand nicks either provided no benefit or led to indel levels that surpassed editing efficiency (up to 26%), even when placed at distances >70 bp from the PEgRNA-induced nick, consistent with an unusual propensity of the edited strand at that site to be nicked by the cell, or to be ligated inefficiently. It is recommend to start with non-edited strand nicks approximately 50 bp from the PEgRNA-mediated nick, and to test alternative nick locations if indel frequencies exceed acceptable levels.

This model for how complementary strand nicking improved prime editing efficiency (FIG. 40A) predicted that nicking the non-edited strand only after edited strand flap resolution could minimize the presence of concurrent nicks, decreasing the frequency of double-strand breaks that go on to form indels. To achieve temporal control over non-edited strand nicking, sgRNAs with spacer sequences that match the edited strand, but not the original allele, were designed. Using this strategy, referred to hereafter as PE3b, mismatches between the spacer and the unedited allele should disfavor nicking by the sgRNA until after the editing event on the PAM strand takes place. This PE3b approach was tested with five different edits at three genomic sites in HEK293T cells and compared outcomes to those achieved with PE2 and PE3 systems. In all cases, PE3b was associated with substantially lower levels of indels compared to PE3 (3.5- to 30-fold, averaging 12-fold lower indels, or 0.85%), without any evident decrease in overall editing efficiency compared to PE3 (FIG. 40C). Therefore, when the edit lay within a second protospacer, the PE3b system could decrease indels while still improving editing efficiency compared to PE2, often to levels similar to those of PE3 (FIG. 40C).

Together, these findings established that PE3 systems (Cas9 nickase-optimized reverse transcriptase+PEgRNA+ sgRNA) improved editing efficiencies ~3-fold compared with PE2 (FIGS. 40B-40C). PE3 was accompanied by wider ranges of indels than PE2, as expected given the additional nicking activity of PE3. The use of PE3 is recommended when prioritizing prime editing efficiency. When minimization of indels is critical, PE2 offers ~10-fold lower indel frequencies. When it is possible to use a sgRNA that recognizes the installed edit to nick the non-edited strand, the PE3b system can achieve PE3-like editing levels while greatly reducing indel formation.

To demonstrate the targeting scope and versatility of prime editing with PE3, the installation of all possible single nucleotide substitutions across the +1 to +8 positions (counting the first base 3' of the PEgRNA-induced nick as position +1) of the HEK3 target site using PE3 and PEgRNAs with 10-nucleotide RT templates (FIG. 41A) was explored. Collectively, these 24 distinct edits cover all four transition mutations and all eight transversion mutations, and proceed with editing efficiencies (containing no indels) averaging 33±7.9% (ranging between 14% and 48%), with an average of 7.5±1.8% indels.

Importantly, long-distance RT templates could also give rise to efficient prime editing with PE3. For example, using PE3 with a 34-nt RT template, point mutations were installed at positions +12, +14, +17, +20, +23, +24, +26, +30, and +33 (12 to 33 bases from the PEgRNA-induced nick) in the HEK3 locus with an average of 36±8.7% efficiency and 8.6±2.0% indels (FIG. 41B). Although edits beyond the +10 position at other loci were not attempted, other RT templates >30 nt at three alternative sites also support efficient editing (FIGS. 48A-C). The viability of long RT templates enabled efficient prime editing for dozens of nucleotides from the initial nick site. Since an NGG PAM on either DNA strand occurs on average every ~8 bp, far less than maximum distances between the edit and the PAM that support efficient prime editing, prime editing is not substantially constrained by the availability of a nearby PAM sequence, in contrast with other precision genome editing methods[125,142,154]. Given the presumed relationship between RNA secondary structure and prime editing efficiency, when designing PEgRNAs for long-range edits it is prudent to test RT templates of various lengths and, if necessary, sequence compositions (e.g., synonymous codons) to optimize editing efficiency.

To further test the scope and limitations of the PE3 system for introducing transition and transversion point mutations, 72 additional edits covering all 12 possible types of point mutations across six additional genomic target sites (FIG. 41C-41H) were tested. Overall, indel-free editing efficiency averaged 25±14%, while indel formation averaged 8.3±7.5%. Since the PEgRNA RT template included the PAM sequence, prime editing could induce changes to the PAM sequence. In these cases, higher editing efficiency (averaging 39±9.7%) and lower indel generation (averaging 5.0±2.9%) were observed (FIGS. 41A-41K, point mutations at positions +5 or +6). This increase in efficiency and decrease in indel formation for PAM edits may arise from the inability of the Cas9 nickase to re-bind and nick the edited strand prior to the repair of the complementary strand. Since prime editing supports combination edits with no apparent loss of editing efficiency, editing the PAM, in addition to other desired changes, when possible, is recommended.

Next, 14 targeted small insertions and 14 targeted small deletions at seven genomic sites using PE3 (FIG. 41I) were performed. Targeted 1-bp insertions proceeded with an average efficiency of 32±9.8%, while 3-bp insertions were installed with an average efficiency of 39±16%. Targeted 1-bp and 3-bp deletions were also efficient, proceeding with an average yield of 29±14% and 32±11%, respectively. Indel generation (beyond the targeted insertion or deletion) averaged 6.8±5.4%. Since insertions and deletions introduced between positions +1 and +6 alter the position or the structure of the PAM, it was speculated that insertion and deletion edits in this range are typically more efficient due to the inability of Cas9 nickase to re-bind and nick the edited DNA strand prior to repair of the complementary strand, similar to point mutations that edit the PAM.

PE3 was also tested for its ability to mediate larger precise deletions of 5 bp to 80 bp at the HEK3 site (FIG. 41J). Very high editing efficiencies (52 to 78%) were observed for 5-, 10-, and 15-bp deletions when using a 13-nt PBS and an RT template that contained 29, 24, or 19 bp of homology to the target locus, respectively. Using a 26-nt RT template supported a larger deletion of 25 bp with 72±4.2% efficiency, while a 20-nt RT template enabled an 80-bp deletion with an efficiency of 52±3.8%. These targeted deletions were accompanied by indel frequencies averaging 11±4.8% (FIG. 41J).

Finally, the ability of PE3 to mediate 12 combinations of multiple edits at the same target locus consisting of insertions and deletions, insertions and point mutations, deletions and point mutations, or two point mutations across three genomic sites was tested. These combination edits were very efficient, averaging 55% of the target edit with 6.4% indels (FIG. 41K), and demonstrating the ability of prime editing to make combinations of precision insertions, deletions, and point mutations at individual target sites with high efficiency and low indel frequencies.

Together, the examples in FIGS. 41A-41K represent 156 distinct transition, transversion, insertion, deletion, and combination edits across seven human genomic loci. These findings establish the versatility, precision, and targeting flexibility of prime editing.

Prime Editing Compared with Base Editing

Current-generation cytidine base editors (CBEs) and adenine base editors (ABEs) can install C.G-to-T.A transition mutations and A.T-to-G.C transition mutations with high efficiency and low indels[129,130,142]. The application of base editing can be limited by the presence of multiple cytidine or adenine bases within the base editing activity window (typically ~5-bp wide), which gives rise to unwanted bystander edits[129,130,142,155], or by the absence of a PAM positioned approximately 15±2 nt from the target nucleotide[142,156]. It was anticipated that prime editing could be particularly useful for precise installation of transitions mutations without bystander edits, or when the lack of suitably positioned PAMs precludes favorable positioning the target nucleotide within the CBE or ABE activity window.

Prime editing and cytosine base editing was compared by editing three genomic loci that contain multiple target cytidines in the canonical base editing window (protospacer positions 4-8, counting the PAM as positions 21-23) using optimized CBEs[157] without nickase activity (BE2max) or with nickase activity (BE4max), or using the analogous PE2 and PE3 prime editing systems. Among the nine total target cytosines within the base editing windows of the three sites, BE4max yielded 2.2-fold higher average total C.G-to-T.A conversion than PE3 for bases in the center of the base editing window (protospacer positions 5-7, FIG. 42A). Likewise, non-nicking BE2max outperformed PE2 by 1.4-fold on average at these well-positioned bases (FIG. 42A). However, PE3 outperformed BE4max by 2.7-fold, and PE2 outperformed BE2max by 2.0-fold, for cytosines beyond the center of the base editing window (average editing of 40±17% for PE3 vs. 15±18% for BE4max, and 22±11% for PE2 vs. 11±13% for BE2max). Overall, indel frequencies for PE2 were very low (averaging 0.86±0.47%), and for PE3 were similar to or modestly higher than that of BE4max (BE4max range: 2.5% to 14%; PE3 range: 2.5% to 21%) (FIG. 42B).

When comparing the efficiency of base editing to prime editing for installation of precise C.G-to-T.A edits (without any bystander editing), the efficiency of prime editing greatly exceeded that of base editing at the above sites, which like most genomic DNA sites, contain multiple cytosines within the ~5-bp base editing window (FIG. 42C). At these sites, such as EMX1, which contains cytosines at protospacer positions C5, C6, and C7, BE4max generated few products containing only the single target base pair conversion with no bystander edits. In contrast, prime editing at this site could be used to selectively install a C.G-to-T.A edit at any position or combination of positions (C5, C6, C7, C5+C6, C6+C7, C5+C7, or C5+C6+C7) (FIG. 42C). All precise one-base or two-base edits (that is, edits that do not modify any other nearby bases) were much more efficient with PE3 or PE2 than with BE4max or BE2, respectively, while the three-base C.G-to-T.A edit was more efficient with BE4max (FIG. 42C), reflecting the propensity of base editors to edit all target bases within the activity window. Taken together, these results demonstrate that cytosine base editors can result in higher levels of editing at optimally positioned target bases than PE2 or PE3, but prime editing can outperform base editing at non-optimally positioned target bases, and can edit with much higher precision with multiple editable bases.

A.T-to-G.C editing was compared at two genomic loci by an optimized non-nicking ABE (ABEmax[152] with a dCas9 instead of a Cas9 nickase, hereafter referred to as ABEdmax) versus PE2, and by the optimized nicking adenine base editor ABEmax versus PE3. At a site that contains two target adenines in the base editing window (HEK3), ABEs were more efficient than PE2 or PE3 for conversion of A5, but PE3 was more efficient for conversion of A8, which lies at the edge of the ABEmax editing window (FIG. 42D). When comparing the efficiency of precision edits in which only a single adenine is converted, PE3 outperformed ABEmax at both A5 and A8 (FIG. 42E). Overall, ABEs produced far fewer indels at HEK3 than prime editors (0.19±0.02% for ABEdmax vs. 1.5±0.46% for PE2, and 0.53±0.16% for ABEmax vs. 11±2.3% for PE3, FIG. 42F). At FANCF, in which only a single A is present within the base editing window, ABE2 and ABEmax outperformed their prime editing counterparts in total target base pair conversion by 1.8- to 2.9-fold, with virtually all edited products from both base editing and prime editing containing only the precise edit (FIGS. 42D-42E). As with the HEK3 site, ABEs produced far fewer indels at the FANCF site (FIG. 42F).

Collectively, these results indicate that base editing and prime editing offer complementary strengths and weaknesses for making targeted transition mutations. For cases in which a single target nucleotide is present within the base editing window, or when bystander edits are acceptable, current base editors are typically more efficient and result in fewer indels than prime editors. When multiple cytosines or adenines are present and bystander edits are undesirable, or when target bases are poorly positioned for base editing relative to available PAMs, prime editors offer substantial advantages.

Off-Target Prime Editing

To result in productive editing, prime editing requires target locus:PEgRNA spacer complementary for the Cas9 domain to bind, target locus:PEgRNA PBS complementarity for PEgRNA-primed reverse transcription to initiate, and target locus:reverse transcriptase product complementarity for flap resolution. It was hypothesized that these three distinct DNA hybridization requirements may minimize off-target prime editing compared to that of other genome editing methods. To test this possibility, HEK293T cells were treated with PE3 or PE2 and 16 total PEgRNAs designed to target four on-target genomic loci, with Cas9 and the four corresponding sgRNAs targeting the same protospacers, or with Cas9 and the same 16 PEgRNAs. These four target loci were chosen because each has at least four well-characterized off-target sites for which Cas9 and the corresponding on-target sgRNA in HEK293T cells is known to cause substantial off-target DNA modification[118,159]. Following treatment, the four on-target loci and the top four known Cas9 off-target sites for each on-target spacer, were sequenced, for a total of 16 off-target sites (Table 1).

Consistent with previous studies[118], Cas9 and the four target sgRNAs modified all 16 of the previously reported off-target loci (FIG. 42G). Cas9 off-target modification efficiency among the four off-target sites for the HEK3 target locus averaged 16%. Cas9 and the sgRNA targeting HEK4 resulted in an average of 60% modification of the four tested known off-target sites. Likewise, off-target sites for EMX1 and FANCF were modified by Cas9:sgRNA at an average frequency of 48% and 4.3%, respectively (FIG. 42G). It was noted that PEgRNAs with Cas9 nuclease modified on-target sites at similar (1- to 1.5-fold lower) efficiency on average compared to sgRNAs, while PEgRNAs with Cas9 nuclease modified off-target sites at ~4-fold lower average efficiency than sgRNAs.

Strikingly, PE3 or PE2 with the same 16 tested PEgRNAs containing these four target spacers resulted in much lower off-target editing (FIG. 42H). Of the 16 sites known to undergo off-target editing by Cas9+sgRNA, PE3+PEgRNAs or PE2+PEgRNAs resulted in detectable off-target prime editing at only 3 of 16 off-target sites, with only 1 of 16 showing off-target editing efficiency ≥1% (FIG. 42H). Average off-target prime editing efficiency for the PEgRNAs targeting HEK3, HEK4, EMX1, and FANCF at these 16 known Cas9 off-target sites was <0.1%, <2.2±5.2%, <0.1%, and <0.13±0.11%, respectively (FIG. 42H). Notably, at the HEK4 off-target 3 site that Cas9+PEgRNA1 edits with 97% efficiency, PE2+PEgRNA1 results in only 0.7% off-target editing despite sharing the same spacer sequence, demonstrating how the two additional DNA hybridization events required for prime editing compared to Cas9 editing can greatly reduce off-target editing. Taken together, these results suggest that PE3 and PEgRNAs induce much lower off-target DNA editing in human cells than Cas9 and sgRNAs that target the same protospacers.

Reverse transcription of 3'-extended PEgRNAs in principle can proceed into the guide RNA scaffold. If the resulting 3' flap, despite a lack of complementary at its 3' end with the unedited DNA strand, is incorporated into the target locus, the outcome is insertion of PEgRNA scaffold nucleotides that contributes to indel frequency. We analyzed sequencing data from 66 PE3-mediated editing experiments at four loci in HEK293T cells and observed PEgRNA scaffold insertion at a low frequency, averaging 1.7±1.5% total insertion of any number of PEgRNA scaffold nucleotides (FIGS. 56A-56D). It is speculated that inaccessibility of the guide RNA scaffold to the reverse transcriptase due to Cas9 domain binding, as well as cellular excision during flap resolution of the mismatched 3' end of the 3' flap that results from PEgRNA scaffold reverse transcription, minimizes products that incorporate PEgRNA scaffold nucleotides. While such events are rare, future efforts to engineer PEgR-NAs or prime editor proteins that minimize PEgRNA scaffold incorporation may further decrease indel frequencies.

Deaminases in some base editors can act in a Cas9-independent manner, resulting in low-level but widespread off-target DNA editing among first-generation CBEs (but not ABEs)[160-162] and off-target RNA editing among first-generation CBEs and ABEs[163-165], although newer CBE and ABE variants with engineered deaminases greatly reduce Cas9-independent off-target DNA and RNA editing[163-165]. Prime editors lack base-modification enzymes such as deaminases, and therefore have no inherent ability to modify DNA or RNA bases in a Cas9-independent manner.

While the reverse transcriptase domain in prime editors in principle could process properly primed RNA or DNA templates in cells, it was noted that retrotransposons such as those in the LINE-1 family[166], endogenous retroviruses[167,168], and human telomerase all provided active endogenous human reverse transcriptases. Their natural presence in human cells suggests that reverse transcriptase activity itself is not substantially toxic. Indeed, no PE3-dependent differences were observed in HEK293T cell viability compared to that of controls expressing dCas9, Cas9 H840A nickase, or PE2 with R110S+K103L (PE2-dRT) mutations that inactivate the reverse transcriptase[169] (FIGS. 49A-49B).

The above data and analyses notwithstanding, additional studies are needed to assess off-target prime editing in an unbiased, genome-wide manner, as well as to characterize the extent to which the reverse transcriptase variants in prime editors, or prime editing intermediates, may affect cells.

Prime Editing Pathogenic Transversion, Insertion, and Deletion Mutations in Human Cells The ability of PE3 to directly install or correct in human cells transversion, small insertion, and small deletion mutations that cause genetic diseases, was tested. Sickle cell disease is most commonly caused by an A.T-to-T.A transversion mutation in HBB, resulting in the mutation of Glu6→Val in beta-globin. Treatment of hematopoietic stem cells ex vivo with Cas9 nuclease and a donor DNA template for HDR, followed by enrichment of edited cells, transplantation, and engraftment is a promising potential strategy for the treatment of sickle-cell disease[170]. However, this approach still generates many indel-containing byproducts in addition to the correctly edited HBB allele[170-171]. While base editors generally produce far fewer indels, they cannot currently make the T.A-to-A.T transversion mutation needed to directly restore the normal sequence of HBB.

PE3 was used to install the HBB E6V mutation in HEK293T cells with 44% efficiency and 4.8% indels (FIG. 43A. From the mixture of PE3-treated cells, we isolated six HEK293T cell lines that are homozygous (triploid) for the HBB E6V allele (FIGS. 53A-53E), demonstrating the ability of prime editing to generate human cell lines with pathogenic mutations. To correct the HBB E6V allele to wild-type HBB, we treated homozygous HBB E6V HEK293T cells with PE3 and a PEgRNA programmed to directly revert the HBB E6V mutation to wild-type HBB. In total, 14 PEgRNA designs were tested. After three days, DNA sequencing revealed that all 14 PEgRNAs when combined with PE3 gave efficient correction of HBB E6V to wild-type HBB (≥26% wild-type HBB without indels), and indel levels averaging 2.8±0.70% (FIG. 50A). The best PEgRNA resulted in 52% correction of HBB E6V to wild-type with 2.4% indels (FIG. 43A). Introduction of a silent mutation that modifies the PAM recognized by the PEgRNA modestly improved editing efficiency and product purity, to 58% correction with 1.4% indels (FIG. 43A). These results establish that prime editing can install and correct a pathogenic transversion point mutation in a human cell line with high efficiency and minimal byproducts.

Tay-Sachs disease is most often caused by a 4-bp insertion into the HEXA gene (HEXA 1278+TATC)[136]. PE3 was used to install this 4-bp insertion into HEK293T cells with 31% efficiency and 0.8% indels (FIG. 43B), and isolated two HEK293T cell lines that are homozygous for the HEXA 1278+TATC allele (FIGS. 53A-53E). These cells were used to test 43 PEgRNAs and three nicking sgRNAs with PE3 or PE3b systems for correction of the pathogenic insertion in HEXA (FIG. 50B), either by perfect reversion to the wild-type allele or by a shifted 4-bp deletion that disrupts the PAM and installs a silent mutation. Nineteen of the 43 PEgRNAs tested resulted in ≥20% editing. Perfect correction to wild-type HEXA with PE3 or PE3b and the best PEgRNA proceeded with similar average efficiencies (30% for PE3 vs. 33% for PE3b), but the PE3b system was accompanied by 5.3-fold fewer indel products (1.7% for PE3 vs. 0.32% for PE3b) (FIG. 43B and FIG. 50B). These findings demonstrate the ability of prime editing to make precise small insertions and deletions that install or correct a pathogenic allele in mammalian cells efficiently and with a minimum of byproducts.

Finally, the installation of a protective SNP into PRNP, the gene encoding the human prion protein (PrP), was tested. PrP misfolding causes progressive and fatal neurodegenerative prion disease that can arise spontaneously, through inherited dominant mutations in the PRNP gene, or through exposure to misfolded PrP[172]. A naturally occurring PRNP G127V mutant allele confers resistance to prion disease in humans[138] and mice[173]. PE3 was used to install G127V into the human PRNP allele in HEK293T cells, which requires a G.C-to-T.A transversion. Four PEgRNAs and three nicking sgRNAs were evaluated with the PE3 system. After three days of exposure to the most effective PE3 and PEgRNA, DNA sequencing revealed 53±11% efficiency of installing the G127V mutation and indel levels of 1.7±0.7% (FIG. 43C). Taken together, these results establish the ability of prime editing in human cells to install or correct transversion, insertion, or deletion mutations that cause or confer resistance to disease efficiently, and with a minimum of byproducts.

Prime Editing in Various Human Cell Lines and Primary Mouse Neurons

Next, prime editing was tested for its ability to edit endogenous sites in three additional human cell lines. In K562 (leukemic bone marrow) cells, PE3 was used to perform transversion edits in the HEK3, EMX1, and FANCF sites, as well as the 18-bp insertion of a 6×His tag in HEK3. An average editing efficiency of 15-30% was observed for each of these four PE3-mediated edits, with indels averaging 0.85-2.2% (FIG. 43A). In U2OS (osteosarcoma) cells, transversion mutations in HEK3 and FANCF were installed, as well as a 3-bp insertion and 6×His tag insertion into HEK3, with 7.9-22% editing efficiency that exceeded indel formation 10- to 76 fold(FIG. 43A). Finally, in HeLa (cervical cancer) cells, a 3-bp insertion into HEK3 was performed, with 12% average efficiency and 1.3% indels (FIG. 43A). Collectively, these data indicate that multiple cell lines beyond HEK293T cells support prime editing, although editing efficiencies vary by cell type and are generally less efficient than in HEK293T cells. Editing:indel ratios remained high in all tested human cell lines.

To determine if prime editing is possible in post-mitotic, terminally differentiated primary cells, primary cortical neurons harvested from E18.5 mice were transduced with a dual split-PE3 lentiviral delivery system in which split-intein splicing[203] reconstitutes PE2 protein from N-terminal and C-terminal halves, each delivered from a separate virus. To restrict editing to post-mitotic neurons, the human synapsin promoter, which is highly specific for mature neurons[204], was used to drive expression of both PE2 protein components. GFP was fused through a self-cleaving P2A peptide[205] to the N-terminal half of PE2. Nuclei from neurons were isolated two weeks following dual viral transduction and were sequenced directly, or sorted for GFP expression before sequencing. A 7.1±1.2% average prime editing to install a transversion at the DNMT1 locus with 0.58±0.14% average indels in sorted nuclei (FIG. 43D was observed. Cas9 nuclease in the same split-intein dual lentivirus system resulted in 31±5.5% indels among sorted cortical neuron nuclei (FIG. 43D. These data indicate that post-mitotic, terminally differentiated primary cells can support prime editing, and thus establish that prime editing does not require cell replication.

Prime Editing Compared with Cas9-Initiated HDR

The performance of PE3 was compared with that of optimized Cas9-initiated HDR[128,125] in mitotic cell lines that support HDR[128]. HEK293T, HeLa, K562 and U2OS cells were treated with Cas9 nuclease, a sgRNA, and an ssDNA donor oligonucleotide template designed to install a variety of transversion and insertion edits (FIGS. 43E-43G, and FIGS. 51A-51G). Cas9-initiated HDR in all cases successfully installed the desired edit, but with far higher levels of byproducts (predominantly indels), as expected from treatments that cause double-stranded breaks. Using PE3 in HEK293T cells, HBB E6V installation and correction proceeded with 42% and 58% average editing efficiency with 2.6% and 1.4% average indels, respectively (FIG. 43E and FIG. 43G). In contrast, the same edits with Cas9 nuclease and an HDR template resulted in 5.2% and 6.7% average editing efficiency, with 79% and 51% average indel frequency (FIG. 43E and FIG. 43G). Similarly, PE3 installed PRNP G127V with 53% efficiency and 1.7% indels, whereas Cas9-initiated HDR installed this mutation with 6.9% efficiency and 53% indels (FIG. 43E and FIG. 43G). Thus, the ratio of editing:indels for HBB E6V installation, HBB E6V correction, and PRNP G127V installation on average was 270-fold higher for PE3 than for Cas9-initiated HDR.

Comparisons between PE3 and HDR in human cell lines other than HEK293T showed similar results, although with lower PE3 editing efficiencies. For example, in K562 cells, PE3-mediated 3-bp insertion into HEK3 proceeded with 25% efficiency and 2.8% indels, compared with 17% editing and 72% indels for Cas9-initiated HDR, a 40-fold editing:indel ratio advantage favoring PE3 (FIGS. 43F-43G). In U2OS cells, PE3 performed this 3-bp insertion with 22% efficiency and 2.2% indels, while Cas9-initiated HDR resulted in 15% editing with 74% indels, a 49-fold lower editing:indel ratio (FIGS. 43F-43G). In HeLa cells, PE3 made this insertion with 12% efficiency and 1.3% indels, versus 3.0% editing and 69% indels for Cas9-initiated HDR, a 210-fold editing:indel ratio difference (FIGS. 43F-43G). Collectively, these data indicated that HDR typically results in similar or lower editing efficiencies and far higher indels than PE3 in the four cell lines tested (FIGS. 51A-51G).

Discussion and Future Directions

The ability to insert DNA sequences with single-nucleotide precision is an especially enabling prime editing capability. For example, PE3 was used to precisely insert into the HEK3 locus in HEK293T cells a His6 tag (18 bp, 65% average efficiency), a FLAG epitope tag (24 bp, 18% average efficiency), and an extended LoxP site (44 bp, 23% average efficiency) that is the native substrate for Cre recombinase. Average indels ranged between 3.0% and 5.9% for these examples (FIG. 43H). Many biotechnological, synthetic biology, and therapeutic applications are envisioned to arise from the ability to efficiently and precisely introduce new DNA sequences into target sites of interest in living cells.

Collectively, the prime editing experiments described herein installed 18 insertions up to 44 bp, 22 deletions up to 80 bp, 113 point mutations including 77 transversions, and 18 combination edits, across 12 endogenous loci in the human and mouse genomes at locations ranging from 3 bp upstream to 29 bp downstream of the start of a PAM without making explicit double-stranded DNA breaks. These results establish prime editing as a remarkably versatile genome editing method. Because the overwhelming majority (85-99%) of insertions, deletions, indels, and duplications in ClinVar are ≤30 bp (FIGS. 52A-52D), in principle prime editing can correct up to ~89% of the 75,122 currently known pathogenic human genetic variants in ClinVar (transitions, transversions, insertions, deletions, indels, and duplications in FIG. 38A), with additional potential to ameliorate diseases caused by copy number gain or loss.

Importantly, for any desired edit the flexibility of prime editing offers many possible choices of PEgRNA-induced nick locations, sgRNA-induced second nick locations, PBS lengths, RT template lengths, and which strand to edit first, as demonstrated extensively herein. This flexibility, which contrasts with more limited options typically available for other precision genome editing methods[125,142,154], allows editing efficiency, product purity, DNA specificity, or other parameters to be optimized to suit the needs of a given application, as shown in FIGS. 50A-50B in which testing 14 and 43 PEgRNAs covering a range of prime editing strategies optimized correction of pathogenic HBB and HEXA alleles, respectively.

Much additional research is needed to further understand and improve prime editing. Additional modifications of prime editor systems may be required to expand their compatibility to include other cell types, such as post-mitotic cells. Interfacing prime editing with viral and non-viral in vitro and in vivo delivery strategies is needed to fully explore the potential of prime editing to enable a wide range of applications including the study and treatment of genetic diseases. By enabling highly precise targeted transitions, transversions, small insertions, and small deletions in the genomes of mammalian cells without requiring double-stranded breaks or HDR, however, prime editing provides a new "search-and-replace" capability that substantially expands the scope of genome editing.

Methods

General Methods

DNA amplification was conducted by PCR using Phusion U Green Multiplex PCR Master Mix (ThermoFisher Scientific) or Q5 Hot Start High-Fidelity 2× Master Mix (New England BioLabs) unless otherwise noted. DNA oligonucleotides, including Cy5-labeled DNA oligonucleotides, dCas9 protein, and Cas9 H840A protein were obtained from Integrated DNA Technologies. Yeast reporter plasmids were derived from previously described plasmids64 and cloned by the Gibson assembly method. All mammalian editor plasmids used herein were assembled using the USER cloning method as previously described[175]. Plasmids expressing sgRNAs were constructed by ligation of annealed oligonucleotides into BsmBI-digested acceptor vector. Plasmids expressing PEgRNAs were constructed by Gibson assembly or Golden Gate assembly using a custom acceptor plasmid (see supplemental 'Golden Gate assembly' outline). Sequences of sgRNA and PEgRNA constructs used herein are listed in Tables 2A-2C and Tables 3A-3R. All vectors for mammalian cell experiments were purified using Plasmid Plus Midiprep kits (Qiagen) or PureYield plasmid miniprep kits (Promega), which include endotoxin removal steps. All experiments using live animals were approved by the Broad Institute Institutional and Animal Care and Use Committees. Wild-type C57BL/6 mice were obtained from Charles River (#027).

In Vitro Biochemical Assays

PEgRNAs and sgRNAs were transcribed in vitro using the HiScribe T7 in vitro transcription kit (New England Biolabs) from PCR-amplified templates containing a T7 promoter sequence. RNA was purified by denaturing urea PAGE and quality-confirmed by an analytical gel prior to use. 5'-Cy5-labeled DNA duplex substrates were annealed using two oligonucleotides (Cy5-AVA024 and AVA025; 1:1.1 ratio) for the non-nicked substrate or three oligonucleotides (Cy5-AVA023, AVA025 and AVA026; 1:1.1:1.1) for the pre-nicked substrate by heating to 95° C. for 3 minutes followed by slowly cooling to room temperature (Tables 2A-2C). Cas9 cleavage and reverse transcription reactions were carried out in 1× cleavage buffer[205] supplemented with dNTPs (20 mM HEPES-K, pH 7.5; 100 mM KCl; 5% glycerol; 0.2 mM EDTA, pH 8.0; 3 mM MgCl2; 0.5 mM dNTP mix; 5 mM DTT). dCas9 or Cas9 H840A (5 µM final) and the sgRNA or PEgRNA (5 µM final) were pre-incubated at room temperature in a 5 µL reaction mixture for 10 minutes prior to the addition of duplex DNA substrate (400 nM final), followed by the addition of Superscript III reverse transcriptase (ThermoFisher Scientific), an undisclosed M-MLV RT variant, when applicable. Reactions were carried out at 37° C. for 1 hour, then diluted to a volume of 10 µL with water, treated with 0.2 µL of proteinase K solution (20 mg/mL, ThermoFisher Scientific), and incubated at room temperature for 30 minutes. Following heat inactivation at 95° C. for 10 minutes, reaction products were combined with 2× formamide gel loading buffer (90% formamide; 10% glycerol; 0.01% bromophenol blue), denatured at 95° C. for 5 minutes, and separated by denaturing urea-PAGE gel (15% TBE-urea, 55° C., 200V). DNA products were visualized by Cy5 fluorescence signal using a Typhoon FLA 7000 biomolecular imager.

Electrophoretic mobility shift assays were carried out in 1× binding buffer (1× cleavage buffer+10 µg/mL heparin) using pre-incubated dCas9:sgRNA or dCas9:PEgRNA complexes (concentration range between 5 nM and 1 µM final) and Cy5-labeled duplex DNA (Cy5-AVA024 and AVA025; 20 nM final). After 15 minutes of incubation at 37° C., the samples were analyzed by native PAGE gel (10% TBE) and imaged for Cy5 fluorescence.

For DNA sequencing of reverse transcription products, fluorescent bands were excised and purified from urea-PAGE gels, then 3' tailed with terminal transferase (TdT; New England Biolabs) in the presence of dGTP or dATP according to the manufacturer's protocol. Tailed DNA products were diluted 10-fold with binding buffer (40% saturated aqueous guanidinium chloride+60% isopropanol) and purified by QIAquick spin column (Qiagen), then used as templates for primer extension by Klenow fragment (New England Biolabs) using primer AVA134 (A-tailed products) or AVA135 (G-tailed products) (Tables 2A-2C). Extension were amplified by PCR for 10 cycles using primers AVA110 and AVA122, then sequenced with AVA037 using the Sanger method (Tables 2A-2C).

Yeast Fluorescent Reporter Assays

Dual fluorescent reporter plasmids containing an in-frame stop codon, a +1 frameshift, or a −1 frameshift were subjected to 5'-extended PEgRNA or 3'-extended PEgRNA prime editing reactions in vitro as described above. Following incubation at 37° C. for 1 hour, the reactions were diluted with water and plasmid DNA was precipitated with 0.3 M sodium acetate and 70% ethanol. Resuspended DNA was transformed into *S. cerevisiae* by electroporation as previously described[67] and plated on synthetic complete media without leucine (SC(glucose), L-). GFP and mCherry fluorescence signals were visualized from colonies with the Typhoon FLA 7000 biomolecular imager.

General Mammalian Cell Culture Conditions

HEK293T (ATCC CRL-3216), U2OS (ATTC HTB-96), K562 (CCL-243), and HeLa (CCL-2) cells were purchased from ATCC and cultured and passaged in Dulbecco's Modified Eagle's Medium (DMEM) plus GlutaMAX (ThermoFisher Scientific), McCoy's 5A Medium (Gibco), RPMI Medium 1640 plus GlutaMAX (Gibco), or Eagle's Minimal Essential Medium (EMEM, ATCC), respectively, each supplemented with 10% (v/v) fetal bovine serum (Gibco, qualified) and 1× Penicillin Streptomycin (Corning). All cell types were incubated, maintained, and cultured at 37° C. with 5% $CO_2$. Cell lines were authenticated by their respective suppliers and tested negative for *mycoplasma*.

HEK293T Tissue Culture Transfection Protocol and Genomic DNA Preparation

HEK293T cells grown were seeded on 48-well poly-D-lysine coated plates (Corning). 16 to 24 hours post-seeding, cells were transfected at approximately 60% confluency with 1 µL of Lipofectamine 2000 (Thermo Fisher Scientific) according to the manufacturer's protocols and 750 ng of PE plasmid, 250 ng of PEgRNA plasmid, and 83 ng of sgRNA plasmid (for PE3 and PE3b). Unless otherwise stated, cells were cultured 3 days following transfection, after which the media was removed, the cells were washed with 1×PBS solution (Thermo Fisher Scientific), and genomic DNA was extracted by the addition of 150 µL of freshly prepared lysis buffer (10 mM Tris-HCl, pH 7.5; 0.05% SDS; 25 µg/mL Proteinase K (ThermoFisher Scientific)) directly into each well of the tissue culture plate. The genomic DNA mixture was incubated at 37° C. for 1 to 2 hours, followed by an 80° C. enzyme inactivation step for 30 minutes. Primers used for mammalian cell genomic DNA amplification are listed in Table 4. For HDR experiments in HEK293T cells, 231 ng of nuclease-expression plasmid, 69 ng of sgRNA expression plasmid, 50 ng (1.51 pmol) 100-nt ssDNA donor template (PAGE-purified; Integrated DNA Technologies) was lipofected using 1.4 µL Lipofectamine 2000 (ThermoFisher) per well. Genomic DNA from all HDR experiments was purified using the Agencourt DNAdvance Kit (Beckman Coulter), according to the manufacturer's protocol.

High-Throughput DNA Sequencing of Genomic DNA Samples

Genomic sites of interest were amplified from genomic DNA samples and sequenced on an Illumina MiSeq as previously described with the following modifications[129, 130]. Briefly, amplification primers containing Illumina forward and reverse adapters (Table 4) were used for a first round of PCR (PCR 1) amplifying the genomic region of interest. 25 µL PCR 1 reactions were performed with 0.5 µM of each forward and reverse primer, 1 µL of genomic DNA extract and 12.5 µL of Phusion U Green Multiplex PCR Master Mix. PCR reactions were carried out as follows: 98° C. for 2 minutes, then 30 cycles of [98° C. for 10 seconds, 61° C. for 20 seconds, and 72° C. for 30 seconds], followed by a final 72° C. extension for 2 minutes. Unique Illumina barcoding primer pairs were added to each sample in a secondary PCR reaction (PCR 2). Specifically, 25 µL of a given PCR 2 reaction contained 0.5 µM of each unique forward and reverse illumina barcoding primer pair, 1 µL of unpurified PCR 1 reaction mixture, and 12.5 µL of Phusion U Green Multiplex PCR 2× Master Mix. The barcoding PCR 2 reactions were carried out as follows: 98° C. for 2 minutes, then 12 cycles of [98° C. for 10 seconds, 61° C. for 20 seconds, and 72° C. for 30 seconds], followed by a final 72° C. extension for 2 minutes. PCR products were evaluated analytically by electrophoresis in a 1.5% agarose gel. PCR 2 products (pooled by common amplicons) were purified by electrophoresis with a 1.5% agarose gel using a QIAquick Gel Extraction Kit (Qiagen), eluting with 40 µL of water. DNA concentration was measured by fluorometric quantification (Qubit, ThermoFisher Scientific) or qPCR (KAPA Library Quantification Kit-Illumina, KAPA Biosystems) and sequenced on an Illumina MiSeq instrument according to the manufacturer's protocols.

Sequencing reads were demultiplexed using MiSeq Reporter (Illumina). Alignment of amplicon sequences to a reference sequence was performed using CRISPResso2[178]. For quantification of point mutation editing, CRISPResso2 was run in standard mode with "discard_indel_reads" on. Editing efficiency was calculated as: (frequency of specified point mutation in non-discarded reads)×(# of non-discarded reads)÷total reads. For insertion or deletion edits, CRISPResso2 was run in HDR mode using the desired allele as the expected allele (e flag), and with "discard_indel_reads" ON. Editing yield was calculated as the number of HDR aligned reads divided by total reads. For all edits, indel yields were calculated as the number of discarded reads divided by total reads.

Nucleofection of U2OS, K562, and HeLa Cells

Nucleofection was performed in all experiments using K562, HeLa, and U2OS cells. For PE conditions in these cell types, 800 ng prime editor-expression plasmid, 200 ng PEgRNA-expression plasmid, and 83 ng nicking plasmid was nucleofected in a final volume of 20 µL in a 16-well nucleocuvette strip (Lonza). For HDR conditions in these three cell types, 350 ng nuclease-expression plasmid, 150 ng sgRNA-expression plasmid and 200 pmol (6.6 µg) 100-nt ssDNA donor template (PAGE-purified; Integrated DNA Technologies) was nucleofected in a final volume of 20 µL per sample in a 16-well Nucleocuvette strip (Lonza). K562 cells were nucleofected using the SF Cell Line 4D-Nucleofector X Kit (Lonza) with $5×10^5$ cells per sample (program FF-120), according to the manufacturers protocol. U2OS cells were nucleofected using the SE Cell Line 4D-Nucleofector X Kit (Lonza) with $3-4×10^5$ cells per sample (program DN-100), according to the manufacturers protocol. HeLa cells were nucleofected using the SE Cell Line 4D-Nucleofector X Kit (Lonza) with $2×10^5$ cells per sample (program CN-114), according to the manufacturers protocol. Cells were harvested 72 hours after nucleofection for genomic DNA extraction.

Genomic DNA Extraction for HDR Experiments

Genomic DNA from all HDR comparison experiments in HEK293T, HEK293T HBB E6V, K562, U2OS, and HeLa cells was purified using the Agencourt DNAdvance Kit (Beckman Coulter), according to the manufacturer's protocol.

Comparison Between PE2, PE3, BE2, BE4max, ABEdmax, and ABEmax

HEK293T cells were seeded on 48-well poly-D-lysine coated plates (Corning). After 16 to 24 hours, cells were transfected at approximately 60% confluency. For base editing with CBE or ABE constructs, cells were transfected with 750 ng of base editor plasmid, 250 ng of sgRNA expression plasmid, and 1 µL of Lipofectamine 2000 (Thermo Fisher Scientific). PE transfections were performed as described above. Genomic DNA extraction for PE and BE was performed as described above.

Determination of PE3 Activity at Known Cas9 Off-Target Sites

To evaluate PE3 off-target editing activity at known Cas9 off-target sites, genomic DNA extracted from HEK293T cells 3 days after transfection with PE3 was used as template for PCR amplification of 16 previously reported Cas9 off-target genomic sites[118,159] (the top four off-target sites each for the HEK3, EMX1, FANCF, and HEK4 spacers; primer sequences are listed in Table 4). These genomic DNA samples were identical to those used for quantifying on-target PE3 editing activities shown in FIGS. 41A-41K; PEgRNA and nicking sgRNA sequences are listed in Tables 3A-3R. Following PCR amplification of off-target sites, amplicons were sequenced on the Illumina MiSeq platform as described above (HTS analysis). For determining Cas9 nuclease, Cas9 H840A nickase, dCas9, and PE2-dRT on-target and off-target editing activity, HEK293T cells were transfected with 750 ng of editor plasmid (Cas9 nuclease, Cas9 H840A nickase, dCas9, or PE2-dRT), 250 ng of PEgRNA or sgRNA plasmid, and 1 µL of Lipofectamine 2000. Genomic DNA was isolated from cells 3 days after transfection as described above. On-target and off-target genomic loci were amplified by PCR using primer sequences in Table 4 and sequenced on an Illumina MiSeq.

HTS data analysis was performed using CRISPResso2[178]. The editing efficiencies of Cas9 nuclease, Cas9 H840A nickase, and dCas9 were quantified as the percent of total sequencing reads containing indels. For quantification of PE3 and PE3-dRT off-targets, aligned sequencing reads were examined for point mutations, insertions, or deletions that were consistent with the anticipated product of PEgRNA reverse transcription initiated at the Cas9 nick site. Single nucleotide variations occurring at <0.1% overall frequency among total reads within a sample were excluded from analysis. For reads containing single nucleotide variations that both occurred at frequencies ≥0.1% and were partially consistent with the PEgRNA-encoded edit, t-tests (unpaired, one-tailed, α=0.5) were used to determine if the variants occurred at significantly higher levels compared to samples treated with PEgRNAs that contained the same spacer but encoded different edits. To avoid differences in sequencing errors, comparisons were made between samples that were sequenced simultaneously within the same MiSeq run. Variants that did not meet the criteria of p-value >0.05 were excluded. Off-target PE3 editing activity was then calculated as the percentage of total sequencing reads that met the above criteria.

Generation of a HEK293T Cell Line Containing the HBB E6V Mutation Using Cas9-Initiated HDR HEK293T cells were seeded in a 48-well plate and transfected at approximately 60% confluency with 1.5 µL of Lipofectamine 2000, 300 ng of Cas9 D10A nickase plasmid, 100 ng of sgRNA plasmid, and 200 ng of 100-mer ssDNA donor template (Table 5). Three days after transfection, media was exchanged for fresh media. Four days after transfection, cells were dissociated using 30 μL of TrypLE solution and suspended in 1.5 mL of media. Single cells were isolated into individual wells of two 96-well plates by fluorescence-activated cell sorting (FACS) (Beckman-Coulter Astrios). See FIGS. 53A-53B for representative FACS sorting examples. Cells were expanded for 14 days prior to genomic DNA sequencing as described above. Of the isolated clonal populations, none was found to be homozygous for the HBB E6V mutation, so a second round of editing by lipofection, sorting, and outgrowth was repeated in a partially edited cell line to yield a cell line homozygous for the E6V allele.

Generation of a HEK293T Cell Line Containing the HBB E6V Mutation Using PE3

2.5×104 HEK293T cells grown in the absence of antibiotic were seeded on 48-well poly-D-lysine coated plates (Corning). 16 to 24 hours post-seeding, cells were transfected at approximately 70% confluency with 1 μL of Lipofectamine 2000 (Thermo Fisher Scientific) according to the manufacturer's protocols and 750 ng of PE2-P2A-GFP plasmid, 250 ng of PEgRNA plasmid, and 83 ng of sgRNA plasmid. After 3 days post transfection, cells were washed with phosphate-buffered saline (Gibco) and dissociated using TrypLE Express (Gibco). Cells were then diluted with DMEM plus GlutaMax (Thermo Fisher Scientific) supplemented with 10% (v/v) FBS (Gibco) and passed through a 35-μm cell strainer (Corning) prior to sorting. Flow cytometry was carried out on a LE-MA900 cell sorter (Sony). Cells were treated with 3 nM DAPI (BioLegend) 15 minutes prior to sorting. After gating for doublet exclusion, single DAPI-negative cells with GFP fluorescence above that of a GFP-negative control cell population were sorted into 96-well flat-bottom cell culture plates (Corning) filled with pre-chilled DMEM with GlutaMax supplemented with 10% FBS. See FIGS. 53A-53B for representative FACS sorting examples. Cells were cultured for 10 days prior to genomic DNA extraction and characterization by HTS, as described above. A total of six clonal cell lines were identified that are homozygous for the E6V mutation in HBB.

Generation of a HEK293T Cell Line Containing the HEXA 1278+TATC Insertion Using PE3

HEK293T cells containing the HEXA 1278+TATC allele were generated following the protocol described above for creation of the HBB E6V cell line; PEgRNA and sgRNA sequences are listed in Tables 2A-2C under the FIGS. 43A-43H subheading. After transfection and sorting, cells were cultured for 10 days prior to genomic DNA extraction and characterization by HTS, as described above. Two heterozygous cell lines were isolated that contained 50% HEXA 1278+TATC alleles, and two homozygous cell lines containing 100% HEXA 1278+TATC alleles were recovered.

Cell Viability Assays

HEK293T cells were seeded in 48-well plates and transfected at approximately 70% confluency with 750 ng of editor plasmid (PE3, PE3 R110S K103L, Cas9 H840A nickase, or dCas9), 250 ng of HEK3-targeting PEgRNA plasmid, and 1 μL of Lipofectamine 2000, as described above. Cell viability was measured every 24 hours post-transfection for 3 days using the CellTiter-Glo 2.0 assay (Promega) according to the manufacturer's protocol. Luminescence was measured in 96-well flat-bottomed polystyrene microplates (Corning) using a M1000 Pro microplate reader (Tecan) with a 1-second integration time.

Lentivirus Production

Lentivirus was produced as previously described[206]. T-75 flasks of rapidly dividing HEK293T cells (ATCC; Manassas, Va., USA) were transfected with lentivirus production helper plasmids pVSV-G and psPAX2 in combination with modified lentiCRISPR_v2 genomes carrying intein-split PE2 editor using FuGENE HD (Promega, Madison, Wis., USA) according to the manufacturer's directions. Four split-intein editor constructs were designed: 1) a viral genome encoding a U6-PEgRNA expression cassette and the N-terminal portion (1-573) of Cas9 H840A nickase fused to the Npu N-intein, a self-cleaving P2A peptide, and GFP-KASH; 2) a viral genome encoding the Npu C-intein fused to the C-terminal remainder of PE2; 3) a viral genome encoding the Npu C-intein fused to the C-terminal remainder of Cas9 for the Cas9 control; and 4) a nicking sgRNA for DNMT1. The split-intein mediates trans splicing to join the two halves of PE2 or Cas9, while the P2A GFP-KASH enables co-translational production of a nuclear membrane-localized GFP. After 48 hours, supernatant was collected, centrifuged at 500 g for 5 minutes to remove cellular debris, and filtered using a 0.45 μm filter. Filtered supernatant was concentrated using the PEG-it Virus Precipitation Solution (System Biosciences, Palo Alto, Calif., USA) according to the manufacturer's directions. The resulting pellet was resuspended in Opti-MEM (Thermo Fisher Scientific, Waltham, Mass., USA) using 1% of the original media volume. Resuspended pellet was flash-frozen and stored at −80° C. until use.

Mouse Primary Cortical Neuron Dissection and Culture

E18.5 dissociated cortical cultures were harvested from timed-pregnant C57BL/6 mice (Charles River). Embryos were harvested from pregnant mice after euthanasia by CO2 followed by decapitation. Cortical caps were dissected in ice-cold Hibernate-E supplemented with penicillin/streptomycin (Life Technologies). Following a rinse with ice-cold Hibernate-E, tissue was digested at 37° C. for 8 minutes in papain/DNase (Worthington/Sigma). Tissue was triturated in NBActiv4 (BrainBits) supplemented with DNase. Cells were counted and plated in 24-well plates at 100,000 cells per well. Half of the media was changed twice per week.

Prime Editing in Primary Neurons and Nuclei Isolation

At DIV 1, 15 μL of lentivirus was added at 10:10:1 ratio of N-terminal:C-terminal:nicking sgRNA. At DIV 14, neuronal nuclei were isolated using the EZ-PREP buffer (Sigma D8938) following the manufacturer's protocol. All steps were performed on ice or at 4° C. Media was removed from dissociated cultures, and cultures were washed with ice-cold PBS. PBS was aspirated and replaced with 200 μL EZ-PREP solution. Following a 5-minute incubation on ice, EZ-PREP was pipetted across the surface of the well to dislodge remaining cells. The sample was centrifuged at 500 g for 5 minutes, and the supernatant removed. Samples were washed with 200 μL EZ-PREP and centrifuged again at 500 g for 5 minutes. Samples were resuspended with gentle pipetting in 200 μL ice-cold Nuclei Suspension Buffer (NSB) consisting of 100 μg/mL BSA and 3.33 μM Vybrant DyeCycle Ruby (Thermo Fisher) in 1×PBS, then centrifuged at 500 g for 5 minutes. The supernatant was removed and nuclei were resuspended in 100 μL NSB and sorted into 100 μL Agencourt DNAdvance lysis buffer using a MoFlo Astrios (Beckman Coulter) at the Broad Institute flow cytometry facility. Genomic DNA was purified according to the manufacturer's Agencourt DNAdvance instructions.

RNA-Sequencing and Data Analysis

HEK293T cells were co-transfected with PRNP-targeting or HEXA-targeting PEgRNAs and PE2, PE2-dRT, or Cas9 H840A nickase. 72 hours following transfection, total RNA was harvested from cells using TRIzol reagent (Thermo Fisher) and purified with RNeasy Mini kit (Qiagen) including on-column DNaseI treatment. Ribosomes were depleted from total RNA using the rRNA removal protocol of the TruSeq Stranded Total RNA library prep kit (Illumina) and subsequently washed with RNAClean XP beads (Beckman Coulter). Sequencing libraries were prepared using ribo-depleted RNA on a SMARTer PrepX Apollo NGS library prep system (Takara) following the manufacturer's protocol. Resulting libraries were visualized on a 2200 TapeStation (Agilent Technologies), normalized using a Qubit dsDNA HS assay (Thermo Fisher), and sequenced on a NextSeq 550 using high output v2 flow cell (Illumina) as 75-bp paired-end reads. Fastq files were generated with bcl2fastq2 version 2.20 and trimmed using TrimGalore version 0.6.2 (github-.com/FelixKrueger/TrimGalore) to remove low-quality bases, unpaired sequences, and adaptor sequences. Trimmed reads were aligned to a Homo sapiens genome assembly GRCh[148] with a custom Cas9 H840A gene entry using RSEM version 1.3.1[207]. The limma-voom[208] package was used to normalize gene expression levels and perform differential expression analysis with batch effect correction. Differentially expressed genes were called with FDR-corrected p-value <0.05 and fold-change >2 cutoffs, and results were visualized in R.

ClinVar Analysis

The ClinVar variant summary was downloaded from NCBI (accessed Jul. 15, 2019), and the information contained therein was used for all downstream analysis. The list of all reported variants was filtered by allele ID in order to remove duplicates and by clinical significance in order to restrict the analysis to pathogenic variants. The list of pathogenic variants was filtered sequentially by variant type in order to calculate the fraction of pathogenic variants that are insertions, deletions, etc. Single nucleotide variants (SNVs) were separated into two categories (transitions and transversions) based on the reported reference and alternate alleles. SNVs that did not report reference or alternate alleles were excluded from the analysis.

The lengths of reported insertions, deletions, and duplications were calculated using reference/alternate alleles, variant start/stop positions, or appropriate identifying information in the variant name. Variants that did not report any of the above information were excluded from the analysis. The lengths of reported indels (single variants that include both insertions and deletions relative to the reference genome) were calculated by determining the number of mismatches or gaps in the best pairwise alignment between the reference and alternate alleles. Frequency distributions of variant lengths were calculated using GraphPad Prism 8.

Data Availability

High-throughput sequencing data are deposited to the NCBI Sequence Read Archive database. Plasmids encoding PE1, PE2/PE3, and PEgRNA expression vectors will be available from Addgene.

Code Availability

The script used to quantify PEgRNA scaffold insertion is provided in FIGS. 60A-60B.

Supplemental Information: Tables and Sequences

TABLE 1

Activities of prime editors, Cas9 nuclease, Cas9 H840A nickase, and PE2-dRT at HEK3, HEK4, EMX1, and FANCF on-target and off-target sites. PE2/PE3 editing is shown as % prime editing alongside % indels (in parentheses). % indels are shown for Cas9, Cas9 H840A nickase (nCas9), and PE2-dRT at the top four previously characterized off-target sites[179,180]. sgRNA and PEgRNA sequences can be found in Tables 3A-3R, under the FIGS. 42A-42H heading. All values are the average of three independent biological replicates.

PE pegRNA

| Site | | HEK3 (PE3) | | | | HEK4 (PE2) | | | | EMX1 (PE3) | | | | FANCF (PE3) | | | |
|---|---|---|---|---|---|---|---|---|---|---|---|---|---|---|---|---|---|
| | sgRNA | 1 | 2 | 3 | 4 | 1 | 2 | 3 | 4 | 1 | 2 | 3 | 4 | 1 | 2 | 3 | 4 |
| On-target | | 44.2 (11.9) | 61.2 (8.8) | 40.4 (16.5) | 48.4 (3.3) | 16.2 (0.9) | 14.4 (1.8) | 9.8 (2.9) | 7.9 (2.2) | 26.6 (3.6) | 14.1 (2.4) | 35.7 (3.3) | 15.4 (2.9) | 56.8 (9.3) | 32.4 (16.7) | 42.8 (13.6) | 47.6 (12.0) |
| Off-target 1 | | <0.1 (<0.1) | <0.1 (<0.1) | <0.1 (<0.1) | <0.1 (<0.1) | <0.1 (<0.1) | 0.4 (<0.1) | <0.1 (<0.1) | 0.4 (<0.1) | <0.1 (<0.1) | <0.1 (<0.1) | <0.1 (<0.1) | <0.1 (<0.1) | <0.1 (<0.1) | 0.6 (<0.1) | <0.1 (<0.1) | <0.1 (<0.1) |
| Off-target 2 | | 6.5 (<0.1) | 12.6 (<0.1) | 11.8 (<0.1) | 4.7 (<0.1) | <0.1 (<0.1) | <0.1 (<0.1) | <0.1 (0.1) | <0.1 (<0.1) | <0.1 (<0.1) | <0.1 (<0.1) | <0.1 (<0.1) | <0.1 (<0.1) | <0.1 (<0.1) | <0.1 (<0.1) | <0.1 (<0.1) | <0.1 (<0.1) |
| Off-target 3 | | 0.6 (<0.1) | 1.7 (<0.1) | 1.5 (<0.1) | 0.5 (<0.1) | 0.2 (0.1) | 6.8 (1.9) | 19.2 (0.5) | 7.9 (3.5) | <0.1 (0.3) | <0.1 (0.3) | <0.1 (0.3) | <0.1 (0.3) | <0.1 (<0.1) | <0.1 (<0.1) | <0.1 (<0.1) | <0.1 (<0.1) |
| Off-target 4 | | <0.1 (0.3) | <0.1 (0.1) | 0.1 (0.1) | <0.1 (<0.1) | <0.1 (<0.1) | <0.1 (0.1) | <0.1 (0.2) | <0.1 (<0.1) | 0.1 (0.1) | 0.1 (0.1) | 0.2 (0.2) | 0.1 (0.1) | <0.1 (<0.1) | <0.1 (<0.1) | <0.1 (<0.1) | <0.1 (<0.1) |

Cas9 pegRNA

| Site | | HEK3 | | | | HEK4 | | | | EMX1 | | | | FANCF | | | |
|---|---|---|---|---|---|---|---|---|---|---|---|---|---|---|---|---|---|
| | sgRNA | 1 | 2 | 3 | 4 | 1 | 2 | 3 | 4 | 1 | 2 | 3 | 4 | 1 | 2 | 3 | 4 |
| On-target | 71.8 | 87.5 | 89.2 | 89.1 | 86.8 | 68.6 | 72.8 | 72.8 | 70.9 | 85.6 | 79.7 | 70.6 | 76.6 | 76.0 | 78.7 | 55.9 | 58.3 | 51.8 | 52.0 |
| Off-target 1 | 54.2 | 1.9 | 5.5 | 5.2 | 1.8 | 39.5 | 48.4 | 49.7 | 49.2 | 81.1 | 63.5 | 48.1 | 53.0 | 59.6 | 12.6 | 1.9 | 1.9 | 1.7 | 1.7 |
| Off-target 2 | 42.5 | 6.5 | 12.6 | 11.8 | 4.7 | 19.5 | 29.4 | 27.3 | 30.3 | 58.3 | 12.0 | 6.0 | 8.2 | 12.9 | 1.1 | 0.2 | 0.2 | 0.2 | 0.1 |
| Off-target 3 | 98.1 | 0.6 | 1.7 | 1.5 | 0.5 | 96.9 | 97.3 | 97.6 | 97.5 | 14.8 | 4.2 | 3.1 | 3.6 | 4.8 | 2.4 | 0.2 | <0.1 | 0.2 | 0.2 |
| Off-target 4 | 45.3 | <0.1 | <0.1 | 0.1 | <0.1 | 16.9 | 28.0 | 27.5 | 29.7 | 39.5 | 1.3 | 0.9 | 0.6 | 1.3 | 1.0 | 0.2 | 0.2 | 0.2 | 0.2 | nCas9 pegRNA

| Site | | HEK3 | | | | HEK4 | | | | EMX1 | | | | FANCF | | | |
|---|---|---|---|---|---|---|---|---|---|---|---|---|---|---|---|---|---|
| | sgRNA | 1 | 2 | 3 | 4 | 1 | 2 | 3 | 4 | 1 | 2 | 3 | 4 | 1 | 2 | 3 | 4 |
| Off-target 1 | | <0.1 | <0.1 | <0.1 | <0.1 | <0.1 | <0.1 | <0.1 | <0.1 | 0.1 | 0.1 | <0.1 | 0.1 | <0.1 | <0.1 | <0.1 | <0.1 |
| Off-target 2 | | <0.1 | <0.1 | <0.1 | <0.1 | <0.1 | <0.1 | <0.1 | <0.1 | 0.3 | 0.1 | <0.1 | <0.1 | <0.1 | <0.1 | <0.1 | <0.1 |
| Off-target 3 | | <0.1 | <0.1 | <0.1 | <0.1 | 0.3 | 0.5 | 0.7 | 0.7 | <0.1 | 0.1 | 0.7 | <0.1 | <0.1 | <0.1 | <0.1 | <0.1 |
| Off-target 4 | | <0.1 | <0.1 | <0.1 | <0.1 | <0.1 | 0.1 | <0.1 | <0.1 | 1.5 | 0.1 | 0.1 | 0.4 | <0.1 | <0.1 | <0.1 | <0.1 |

TABLE 1-continued

Activities of prime editors, Cas9 nuclease, Cas9 H840A nickase, and PE2-dRT at HEK3, HEK4, EMX1, and FANCF on-target and off-target sites. PE2/PE3 editing is shown as % prime editing alongside % indels (in parentheses). % indels are shown for Cas9, Cas9 H840A nickase (nCas9), and PE2-dRT at the top four previously characterized off-target sites[179,180]. sgRNA and PEgRNA sequences can be found in Tables 3A-3R, under the FIGS. 42A-42H heading. All values are the average of three independent biological replicates.

| | PE2-dRT pegRNA | | | | | | | | | | | | | | | | | | | | |
|---|---|---|---|---|---|---|---|---|---|---|---|---|---|---|---|---|---|---|---|---|---|
| | HEK3 | | | | | HEK4 | | | | | EMX1 | | | | | FANCF | | | | | |
| Site | — | 1 | 2 | 3 | 4 | — | 1 | 2 | 3 | 4 | — | 1 | 2 | 3 | 4 | — | 1 | 2 | 3 | 4 |
| Off-target 1 | | <0.1 | <0.1 | <0.1 | <0.1 | | 0.1 | 0.2 | <0.1 | <0.1 | | 0.1 | 0.1 | 0.1 | 0.1 | | <0.1 | <0.1 | <0.1 | <0.1 |
| Off-target 2 | | <0.1 | <0.1 | <0.1 | <0.1 | | <0.1 | 0.1 | <0.1 | <0.1 | | <0.1 | 0.3 | <0.1 | <0.1 | | <0.1 | <0.1 | <0.1 | <0.1 |
| Off-target 3 | | <0.1 | <0.1 | <0.1 | <0.1 | | <0.1 | 0.1 | 1.4 | 0.9 | | <0.1 | <0.1 | <0.1 | <0.1 | | <0.1 | <0.1 | <0.1 | <0.1 |
| Off-target 4 | | <0.1 | <0.1 | <0.1 | <0.1 | | 0.1 | 0.1 | 0.1 | 0.2 | | 0.9 | 0.1 | 0.1 | 0.2 | | <0.1 | <0.1 | <0.1 | <0.1 |

Tables 2A-2C: Sequences of DNA oligonucleotides, PEgRNAs, and sgRNAs used for in vitro experiments.

TABLE 2A

DNA oligonucleotides

| OLIGONUC-LEOTIDE | SEQUENCE |
|---|---|
| AVA023 | 5CY5-CCTGGGTCAATCCTTGGGGCCCAGACTGAGCACG (SEQ ID NO: 374) |
| AVA024 | 5CY5-CCTGGGTCAATCCTTGGGGCCCAGACTGAGCACGTGATGGCAGAGGAAAGG (SEQ ID NO: 375) |
| AVA025 | 5PHOS-CCTTTCCTCTGCCATCACGTGCTCAGTCTGGGCCCAAGGATTGACCCAGG (SEQ ID NO: 376) |
| AVA026 | 5PHOS-TGATGGCAGAGGAAAGG (SEQ ID NO: 377) |
| AVA037 | GCAGGCTTTAAAGGAACCAATTC (SEQ ID NO: 378) |
| AVA110 | GCAGGCTTTAAAGGAACCAATTCCCTGGGTCAATCCTTGGGGC (SEQ ID NO: 379) |
| AVA122 | CTCTGGAGGATCTAGCGGAG (SEQ ID NO: 380) |
| AVA134 | CTCTGGAGGATCTAGCGGAGTTTTTTTTTTTTTTTTTT (SEQ ID NO: 381) |
| AVA135 | CTCTGGAGGATCTAGCGGAGCCCCCCCCCCCCCC (SEQ ID NO: 382) |

TABLE 2B

5'-extended PEgRNAs

| PEGRNA | SPACER SEQUENCE | 5' EXTENSION SEQUENCE | LINKER LENGTH (NT) | PBS LENGTH (NT) | RT TEMPLATE LENGTH (NT) |
|---|---|---|---|---|---|
| PEGRNA 1 | GGCCCAGACTGAGCACGTGA (SEQ ID NO: 383) | GGCTAACCGTGCCATTTGATCAGGTCA (SEQ ID NO: 429) | 15 | 5 | 7 |
| PEGRNA 2 | GGCCCAGACTGAGCACGTGA (SEQ ID NO: 384) | GGCTAACCGTGCAAATTAACAAACTAA (SEQ ID NO: 430) | 15 | 5 | 7 |
| PEGRNA 3 | GGCCCAGACTGAGCACGTGA (SEQ ID NO: 385) | GGCCATCTCGTGCAAATTAACAAACTAA (SEQ ID NO: 431) | 15 | 5 | 8 |
| PEGRNA 4 | GGCCCAGACTGAGCACGTGA (SEQ ID NO: 386) | GGTCCTCTGCCATCTCGTGCAAATTAACAAACTAA (SEQ ID NO: 432) | 15 | 5 | 15 |
| PEGRNA 5 | GGCCCAGACTGAGCACGTGA (SEQ ID NO: 387) | GGCTTCCTTTCCTCTGCCATCTCGTGCAAATTAACAAACTAA (SEQ ID NO: 433) | 15 | 5 | 22 |
| 5'-PEGRNA_RT_7_A | GGCCCAGACTGAGCACGTGA (SEQ ID NO: 388) | GGCTAACCGTGCCATTTGATCAGGTCA (SEQ ID NO: 434) | 15 | 5 | 7 |
| 5'-PEGRNA_RT_7_B | GGCCCAGACTGAGCACGTGA (SEQ ID NO: 389) | GGCTAACCGTGCAAATTAACAAACTAA (SEQ ID NO: 435) | 15 | 5 | 7 |
| 5'-PEGRNA_RT_8 | GGCCCAGACTGAGCACGTGA (SEQ ID NO: 390) | GGCCATCTCGTGCAAATTAACAAACTAA (SEQ ID NO: 436) | 15 | 5 | 8 |
| 5'-PEGRNA_RT_15 | GGCCCAGACTGAGCACGTGA (SEQ ID NO: 391) | GGTCCTCTGCCATCTCGTGCAAATTAACAAACTAA (SEQ ID NO: 437) | 15 | 5 | 15 |
| 5'-PEGRNA_RT_15 | GGCCCAGACTGAGCACGTGA (SEQ ID NO: 392) | GGCTTCCTTTCCTCTGCCATCTCGTGCAAATTAACAAACTAA (SEQ ID NO: 438) | 15 | 5 | 22 |

TABLE 2C

| | | 3' |-extended PEgRNAs | |
|---|---|---|---|---|
| PEGRNA | SPACER SEQUENCE | 3' EXTENSION SEQUENCE | PBS LENGTH (NT) | RT TEMPLATE LENGTH (NT) |
| 3'-PEGRNA_10 | GGCCCAGACTGAG CACGTGA(SEQ ID NO: 506) | TCTGCCATCTCG TGCTC (SEQ ID NO: 439) | 7 | 10 |
| 3'-PEGRNA_YEAST_T TOA | GGCCCAGACTGAG CACGTGA(SEQ ID NO: 507) | TCTGCCATCTCG TGCTC(SEQ ID NO: 440) | 7 | 10 |
| 3'-PEGRNA_YEAST_+ 1AINS | GGCCCAGACTGAG CACGTGA(SEQ ID NO: 508) | TCTGCCATCATC GTGCTC(SEQ ID NO: 441) | 7 | 11 |
| 3'-PEGRNA_YEAST_+ 1TDEL | GGCCCAGACTGAG CACGTGA(SEQ ID NO: 509) | TCTGCCATCCGT GCTC(SEQ ID NO: 442) | 7 | 9 |

Tables 3A-3R: Sequences of PEgRNAs and sgRNAs used in mammalian cell experiments. All sequences are shown in 5' to 3' orientation. To construct PEgRNAs, spacer sequences listed below were added to the 5' end of the sgRNA scaffold and the 3' extensions listed below containing the primer binding site and RT template were added to the 3' end of the sgRNA scaffold. The sgRNA scaffold sequence is GTTTTAGAGCTAGAAATAGCAAGT-TAAAATAAGGCTAGTCCGTTATCAACTTGAA AAAGTGGCACCGAGTCGGTGC (SEQ ID NO: 131).

TABLE 3A

| | FIGs. 39A-39D PEgRNA | | | |
|---|---|---|---|---|
| PEGRNA | SPACER SEQUENCE (SEQ ID NOS: 2890-2996) | 3' EXTENSION (SEQ ID NOS: 2997-3103) | PBS LENGTH (NT) | RT TEMPLATE LENGTH (NT) |
| HEK3_2B-C_8 | GGCCCAGACTGAG CACGTGA | TCTGCCATCTCGTGCTCA | 8 | 10 |
| HEK3_2B-C_9 | GGCCCAGACTGAG CACGTGA | TCTGCCATCTCGTGCTCAG | 9 | 10 |
| HEK3_2B-C_10 | GGCCCAGACTGAG CACGTGA | TCTGCCATCTCGTGCTCAGT | 10 | 10 |
| HEK3_2B-C_11 | GGCCCAGACTGAG CACGTGA | TCTGCCATCTCGTGCTCAGTC | 11 | 10 |
| HEK3_2B-C_12 | GGCCCAGACTGAG CACGTGA | TCTGCCATCTCGTGCTCAGTCT | 12 | 10 |
| HEK3_2B-C_13 | GGCCCAGACTGAG CACGTGA | TCTGCCATCTCGTGCTCAGTCTG | 13 | 10 |
| HEK3_2B-C_14 | GGCCCAGACTGAG CACGTGA | TCTGCCATCTCGTGCTCAGTCTGG | 14 | 10 |
| HEK3_2B-C_15 | GGCCCAGACTGAG CACGTGA | TCTGCCATCTCGTGCTCAGTCTGGG | 15 | 10 |
| HEK3_2C_16 | GGCCCAGACTGAG CACGTGA | TCTGCCATCTCGTGCTCAGTCTGGGC | 16 | 10 |
| HEK3_2C_17 | GGCCCAGACTGAG CACGTGA | TCTGCCATCTCGTGCTCAGTCTGGGCC | 17 | 10 |
| EMX1_2C_9 | GAGTCCGAGCAGA AGAAGAA | ATGGGAGCACTTCTTCTT CTGC | 9 | 13 |
| EMX1_2C_10 | GAGTCCGAGCAGA AGAAGAA | ATGGGAGCACTTCTTCTT CTGCT | 10 | 13 |
| EMX1_2C_11 | GAGTCCGAGCAGA AGAAGAA | ATGGGAGCACTTCTTCTT CTGCTC | 11 | 13 |

TABLE 3A-continued

| FIGs. 39A-39D PEgRNA | | | | |
|---|---|---|---|---|
| PEGRNA | SPACER SEQUENCE (SEQ ID NOS: 2890-2996) | 3' EXTENSION (SEQ ID NOS: 2997-3103) | PBS LENGTH (NT) | RT TEMPLATE LENGTH (NT) |
| EMX1_2C_12 | GAGTCCGAGCAGAAGAAGAA | ATGGGAGCACTTCTTCTTCTGCTCG | 12 | 13 |
| EMX1_2C_13 | GAGTCCGAGCAGAAGAAGAA | ATGGGAGCACTTCTTCTTCTGCTCGG | 13 | 13 |
| EMX1_2C_14 | GAGTCCGAGCAGAAGAAGAA | ATGGGAGCACTTCTTCTTCTGCTCGGA | 14 | 13 |
| EMX1_2C_15 | GAGTCCGAGCAGAAGAAGAA | ATGGGAGCACTTCTTCTTCTGCTCGGAC | 15 | 13 |
| EMX1_2C_16 | GAGTCCGAGCAGAAGAAGAA | ATGGGAGCACTTCTTCTTCTGCTCGGACT | 16 | 13 |
| EMX1_2C_17 | GAGTCCGAGCAGAAGAAGAA | ATGGGAGCACTTCTTCTTCTGCTCGGACTC | 17 | 13 |
| FANCF_2C_8 | GGAATCCCTTCTGCAGCACC | GGAAAAGCGATCAAGGTGCTGCAGA | 8 | 17 |
| FANCF_2C_9 | GGAATCCCTTCTGCAGCACC | GGAAAAGCGATCAAGGTGCTGCAGAA | 9 | 17 |
| FANCF_2C_10 | GGAATCCCTTCTGCAGCACC | GGAAAAGCGATCAAGGTGCTGCAGAAG | 10 | 17 |
| FANCF_2C_11 | GGAATCCCTTCTGCAGCACC | GGAAAAGCGATCAAGGTGCTGCAGAAGG | 11 | 17 |
| FANCF_2C_12 | GGAATCCCTTCTGCAGCACC | GGAAAAGCGATCAAGGTGCTGCAGAAGGG | 12 | 17 |
| FANCF_2C_13 | GGAATCCCTTCTGCAGCACC | GGAAAAGCGATCAAGGTGCTGCAGAAGGGA | 13 | 17 |
| FANCF_2C_14 | GGAATCCCTTCTGCAGCACC | GGAAAAGCGATCAAGGTGCTGCAGAAGGGAT | 14 | 17 |
| FANCF_2C_15 | GGAATCCCTTCTGCAGCACC | GGAAAAGCGATCAAGGTGCTGCAGAAGGGATT | 15 | 17 |
| FANCF_2C_16 | GGAATCCCTTCTGCAGCACC | GGAAAAGCGATCAAGGTGCTGCAGAAGGGATTC | 16 | 17 |
| FANCF_2C_17 | GGAATCCCTTCTGCAGCACC | GGAAAAGCGATCAAGGTGCTGCAGAAGGGATTCC | 17 | 17 |
| RNF2_2C_9 | GTCATCTTAGTCATTACCTG | GAACACCTCATGTAATGACT | 9 | 11 |
| RNF2_2C_10 | GTCATCTTAGTCATTACCTG | GAACACCTCATGTAATGACTA | 10 | 11 |
| RNF2_2C_11 | GTCATCTTAGTCATTACCTG | GAACACCTCATGTAATGACTAA | 11 | 11 |
| RNF2_2C_12 | GTCATCTTAGTCATTACCTG | GAACACCTCATGTAATGACTAAG | 12 | 11 |
| RNF2_2C_13 | GTCATCTTAGTCATTACCTG | GAACACCTCATGTAATGACTAAGA | 13 | 11 |
| RNF2_2C_14 | GTCATCTTAGTCATTACCTG | GAACACCTCATGTAATGACTAAGAT | 14 | 11 |
| RNF2_2C_15 | GTCATCTTAGTCATTACCTG | GAACACCTCATGTAATGACTAAGATG | 15 | 11 |
| RNF2_2C_16 | GTCATCTTAGTCATTACCTG | GAACACCTCATGTAATGACTAAGATGA | 16 | 11 |

TABLE 3A-continued

| | FIGs. 39A-39D PEgRNA | | | |
|---|---|---|---|---|
| PEGRNA | SPACER SEQUENCE (SEQ ID NOS: 2890-2996) | 3' EXTENSION (SEQ ID NOS: 2997-3103) | PBS LENGTH (NT) | RT TEMPLATE LENGTH (NT) |
| RNF2_2C_17 | GTCATCTTAGTCATTACCTG | GAACACCTCATGTAATGACTAAGATGAC | 17 | 11 |
| HEK4_2C_7 | GGCACTGCGGCTGGAGGTGG | GCTTTAACCCCAACCTCCAG | 7 | 13 |
| HEK4_2C_8 | GGCACTGCGGCTGGAGGTGG | GCTTTAACCCCAACCTCCAGC | 8 | 13 |
| HEK4_2C_9 | GGCACTGCGGCTGGAGGTGG | GCTTTAACCCCAACCTCCAGCC | 9 | 13 |
| HEK4_2C_10 | GGCACTGCGGCTGGAGGTGG | GCTTTAACCCCAACCTCCAGCCG | 10 | 13 |
| HEK4_2C_11 | GGCACTGCGGCTGGAGGTGG | GCTTTAACCCCAACCTCCAGCCGC | 11 | 13 |
| HEK4_2C_12 | GGCACTGCGGCTGGAGGTGG | GCTTTAACCCCAACCTCCAGCCGCA | 12 | 13 |
| HEK4_2C_13 | GGCACTGCGGCTGGAGGTGG | GCTTTAACCCCAACCTCCAGCCGCAG | 13 | 13 |
| HEK4_2C_14 | GGCACTGCGGCTGGAGGTGG | GCTTTAACCCCAACCTCCAGCCGCAGT | 14 | 13 |
| HEK4_2C_15 | GGCACTGCGGCTGGAGGTGG | GCTTTAACCCCAACCTCCAGCCGCAGTG | 15 | 13 |
| HEK3_2C_1TDEL | GGCCCAGACTGAGCACGTGA | TCTGCCATCCGTGCTCAGTCTG | 13 | 10 |
| HEK3_2C_1AINS | GGCCCAGACTGAGCACGTGA | TCTGCCATCATCGTGCTCAGTCTG | 13 | 10 |
| HEK3_2C_1CTTINS | GGCCCAGACTGAGCACGTGA | TCTGCCATCAAAGCGTGCTCAGTCTG | 13 | 10 |
| HEK3_2D_10 | GGCCCAGACTGAGCACGTGA | TCTGCCATCTCGTGCTCAGTCTG | 13 | 10 |
| HEK3_2D_11 | GGCCCAGACTGAGCACGTGA | CTCTGCCATCTCGTGCTCAGTCTG | 13 | 11 |
| HEK3_2D_12 | GGCCCAGACTGAGCACGTGA | CCTCTGCCATCTCGTGCTCAGTCTG | 13 | 12 |
| HEK3_2D_13 | GGCCCAGACTGAGCACGTGA | TCCTCTGCCATCTCGTGCTCAGTCTG | 13 | 13 |
| HEK3_2D_14 | GGCCCAGACTGAGCACGTGA | TTCCTCTGCCATCTCGTGCTCAGTCTG | 13 | 14 |
| HEK3_2D_15 | GGCCCAGACTGAGCACGTGA | TTTCCTCTGCCATCTCGTGCTCAGTCTG | 13 | 15 |
| HEK3_2D_16 | GGCCCAGACTGAGCACGTGA | CTTTCCTCTGCCATCTCGTGCTCAGTCTG | 13 | 16 |
| HEK3_2D_17 | GGCCCAGACTGAGCACGTGA | CCTTTCCTCTGCCATCTCGTGCTCAGTCTG | 13 | 17 |
| HEK3_2D_18 | GGCCCAGACTGAGCACGTGA | TCCTTTCCTCTGCCATCTCGTGCTCAGTCTG | 13 | 18 |
| HEK3_2D_19 | GGCCCAGACTGAGCACGTGA | TTCCTTTCCTCTGCCATCTCGTGCTCAGTCTG | 13 | 19 |
| HEK3_2D_20 | GGCCCAGACTGAGCACGTGA | CTTCCTTTCCTCTGCCATCTCGTGCTCAGTCTG | 13 | 20 |

TABLE 3A-continued

| | FIGs. 39A-39D PEgRNA | | | |
|---|---|---|---|---|
| PEGRNA | SPACER SEQUENCE (SEQ ID NOS: 2890-2996) | 3' EXTENSION (SEQ ID NOS: 2997-3103) | PBS LENGTH (NT) | RT TEMPLATE LENGTH (NT) |
| EMX1_2D_10 | GAGTCCGAGCAGAAGAAGAA | GGAGCCCTTGTTCTTCTGCTCGG | 13 | 10 |
| EMX1_2D_11 | GAGTCCGAGCAGAAGAAGAA | GGGAGCCCTTGTTCTTCTGCTCGG | 13 | 11 |
| EMX1_2D_12 | GAGTCCGAGCAGAAGAAGAA | TGGGAGCCCTTGTTCTTCTGCTCGG | 13 | 12 |
| EMX1_2D_13 | GAGTCCGAGCAGAAGAAGAA | ATGGGAGCCCTTGTTCTTCTGCTCGG | 13 | 13 |
| EMX1_2D_14 | GAGTCCGAGCAGAAGAAGAA | GATGGGAGCCCTTGTTCTTCTGCTCGG | 13 | 14 |
| EMX1_2D_15 | GAGTCCGAGCAGAAGAAGAA | TGATGGGAGCCCTTGTTCTTCTGCTCGG | 13 | 15 |
| EMX1_2D_16 | GAGTCCGAGCAGAAGAAGAA | GTGATGGGAGCCCTTGTCTTCTGCTCGG | 13 | 16 |
| EMX1_2D_17 | GAGTCCGAGCAGAAGAAGAA | TGTGATGGGAGCCCTTGTTCTTCTGCTCGG | 13 | 17 |
| EMX1_2D_18 | GAGTCCGAGCAGAAGAAGAA | ATGTGATGGGAGCCCTTGTTCTTCTGCTCGG | 13 | 18 |
| EMX1_2D_19 | GAGTCCGAGCAGAAGAAGAA | GATGTGATGGGAGCCCTGTTCTTCTGCTCGG | 13 | 19 |
| EMX1_2D_20 | GAGTCCGAGCAGAAGAAGAA | TGATGTGATGGGAGCCCTTGTTCTTCTGCTCGG | 13 | 20 |
| FANCF_2D_10 | GGAATCCCTTCTGCAGCACC | CGATCAAGGTGCTGCAGAAGGGA | 13 | 10 |
| FANCF_2D_11 | GGAATCCCTTCTGCAGCACC | GCGATCAAGGTGCTGCAGAAGGGA | 13 | 11 |
| FANCF_2D_12 | GGAATCCCTTCTGCAGCACC | AGCGATCAAGGTGCTGCAGAAGGGA | 13 | 12 |
| FANCF_2D_13 | GGAATCCCTTCTGCAGCACC | AAGCGATCAAGGTGCTGCAGAAGGGA | 13 | 13 |
| FANCF_2D_14 | GGAATCCCTTCTGCAGCACC | AAAGCGATCAAGGTGCTGCAGAAGGGA | 13 | 14 |
| FANCF_2D_15 | GGAATCCCTTCTGCAGCACC | AAAAGCGATCAAGGTGCTGCAGAAGGGA | 13 | 15 |
| FANCF_2D_16 | GGAATCCCTTCTGCAGCACC | GAAAAGCGATCAAGGTGCTGCAGAAGGGA | 13 | 16 |
| FANCF_2D_17 | GGAATCCCTTCTGCAGCACC | GGAAAAGCGATCAAGGTGCTGCAGAAGGGA | 13 | 17 |
| FANCF_2D_18 | GGAATCCCTTCTGCAGCACC | CGGAAAAGCGATCAAGGTGCTGCAGAAGGGA | 13 | 18 |
| FANCF_2D_19 | GGAATCCCTTCTGCAGCACC | TCGGAAAAGCGATCAAGGTGCTGCAGAAGGGA | 13 | 19 |
| FANCF_2D_20 | GGAATCCCTTCTGCAGCACC | CTCGGAAAAGCGATCAAGGTGCTGCAGAAGGGA | 13 | 20 |
| RNF2_2D_10 | GTCATCTTAGTCATTACCTG | AACACCTCATGTAATGACTAAGATG | 15 | 10 |
| RNF2_2D_11 | GTCATCTTAGTCATTACCTG | GAACACCTCATGTAATGACTAAGATG | 15 | 11 |

TABLE 3A-continued

| | FIGs. 39A-39D PEgRNA | | | |
|---|---|---|---|---|
| PEGRNA | SPACER SEQUENCE (SEQ ID NOS: 2890-2996) | 3' EXTENSION (SEQ ID NOS: 2997-3103) | PBS LENGTH (NT) | RT TEMPLATE LENGTH (NT) |
| RNF2_2D_12 | GTCATCTTAGTCATTACCTG | CGAACACCTCATGTAATGACTAAGATG | 15 | 12 |
| RNF2_2D_13 | GTCATCTTAGTCATTACCTG | ACGAACACCTCATGTAATGACTAAGATG | 15 | 13 |
| RNF2_2D_14 | GTCATCTTAGTCATTACCTG | AACGAACACCTCATGTAATGACTAAGATG | 15 | 14 |
| RNF2_2D_15 | GTCATCTTAGTCATTACCTG | CAACGAACACCTCATGTAATGACTAAGATG | 15 | 15 |
| RNF2_2D_16 | GTCATCTTAGTCATTACCTG | ACAACGAACACCTCATGTAATGACTAAGATG | 15 | 16 |
| RNF2_2D_17 | GTCATCTTAGTCATTACCTG | TACAACGAACACCTCATGTAATGACTAAGATG | 15 | 17 |
| RNF2_2D_18 | GTCATCTTAGTCATTACCTG | TTACAACGAACACCTCATGTAATGACTAAGATG | 15 | 18 |
| RNF2_2D_19 | GTCATCTTAGTCATTACCTG | GTTACAACGAACACCTCATGTAATGACTAAGATG | 15 | 19 |
| RNF2_2D_20 | GTCATCTTAGTCATTACCTG | AGTTACAACGAACACCTCATGTAATGACTAAGATG | 15 | 20 |
| HEK4_2D_7 | GGCACTGCGGCTGGAGGTGG | ACCCCAACCTCCAGCCGC | 11 | 7 |
| HEK4_2D_8 | GGCACTGCGGCTGGAGGTGG | AACCCCAACCTCCAGCCGC | 11 | 8 |
| HEK4_2D_9 | GGCACTGCGGCTGGAGGTGG | TAACCCCAACCTCCAGCCGC | 11 | 9 |
| HEK4_2D_10 | GGCACTGCGGCTGGAGGTGG | TTAACCCCAACCTCCAGCCGC | 11 | 10 |
| HEK4_2D_11 | GGCACTGCGGCTGGAGGTGG | TTTAACCCCAACCTCCAGCCGC | 11 | 11 |
| HEK4_2D_12 | GGCACTGCGGCTGGAGGTGG | CTTTAACCCCAACCTCCAGCCGC | 11 | 12 |
| HEK4_2D_13 | GGCACTGCGGCTGGAGGTGG | GCTTTAACCCCAACCTCCAGCCGC | 11 | 13 |
| HEK4_2D_14 | GGCACTGCGGCTGGAGGTGG | CGCTTTAACCCCAACCTCCAGCCGC | 11 | 14 |
| HEK4_2D_15 | GGCACTGCGGCTGGAGGTGG | CCGCTTTAACCCCAACCTCCAGCCGC | 11 | 15 |
| HEK4_2D_16 | GGCACTGCGGCTGGAGGTGG | TCCGCTTTAACCCCAACCTCCAGCCGC | 11 | 16 |
| HEK4_2D_17 | GGCACTGCGGCTGGAGGTGG | CTCCGCTTTAACCCCAACCTCCAGCCGC | 11 | 17 |
| HEK4_2D_18 | GGCACTGCGGCTGGAGGTGG | CTCCGCTTTAACCCCAACCTCCAGCCGC | 11 | 18 |
| HEK4_2D_19 | GGCACTGCGGCTGGAGGTGG | CTCCGCTTTAACCCCAACCTCCAGCCGC | 11 | 19 |

TABLE 3B

FIGs. 40A-40C PEgRNA

| PEGRNA | SPACER SEQUENCE (SEQ ID NO: 3104-3112) | 3' EXTENSION (SEQ ID NOS: 3113-3121) | PBS LENGTH (NT) | RT TEMPLATE LENGTH (NT) |
|---|---|---|---|---|
| RNF2_3B | GTCATCTTAGTCATTACCTG | AACGAACACCTCATGTAATGACTAAGATG | 15 | 14 |
| EMX1_3B | GAGTCCGAGCAGAAGAAGAA | ATGGGAGCACTTCTTCTTCTGCTCGGAC | 15 | 13 |
| FANCF_3B | GGAATCCCTTCTGCAGCACC | GGAAAAGCGATCAAGGTGCTGCAGAAGGGATT | 15 | 17 |
| HE3_3B | GGCCCAGACTGAGCACGTGA | TCTGCCATGACGTGCTCAGTCTG | 13 | 10 |
| HEK4_3B | GGCACTGCGGCTGGAGGTGG | TTAACCCCAACCTCCAGCC | 9 | 10 |
| RNF2_3C_4ATOC | GTCATCTTAGTCATTACCTG | AACGAACACCGCAGGTAATGACTAAGATG | 15 | 14 |
| RNF2_3C_4ATOG | GTCATCTTAGTCATTACCTG | AACGAACACCCCAGGTAATGACTAAGATG | 15 | 14 |
| FANCF_3C_5GTOT | GGAATCCCTTCTGCAGCACC | GGAAAAGCGATCAAGGTGCTGCAGAAGGGA | 13 | 17 |
| FANCF_3C_7ATOC | GGAATCCCTTCTGCAGCACC | GGAAAAGCGAGCCAGGTGCTGCAGAAGGGAT | 14 | 17 |

TABLE 3C

FIGs. 40A-40C nicking sgRNA sequences

| NICKING SGRNA | SPACER SEQUENCE | SEQ ID NO: |
|---|---|---|
| RNF2_2B_+41 | GTCAACCATTAAGCAAAACAT | 3122 |
| RNF2_2B_+67 | GTCTCAGGCTGTGCAGACAAA | 3123 |
| EMX1_2B_-116 | GGGGCACAGATGAGAAACTC | 3124 |
| EMX1_2B_-57 | GCCGTTTGTACTTTGTCCTC | 3125 |
| EMX1_2B_+14 | GCGCCACCGGTTGATGTGAT | 3126 |
| EMX1_2B_+27 | GCTTCGTGGCAATGCGCCAC | 3127 |
| EMX1_2B_+53 | GACATCGATGTCCTCCCCAT | 3128 |
| EMX1_2B_+80 | GTGGTTGCCCACCCTAGTCAT | 3129 |
| FANCF_2B_-78 | GCGACTCTCTGCGTACTGAT | 3130 |
| FANCF_2B_-50 | GCCCTACTTCCGCTTTCACCT | 3131 |
| FANCF_2B_-27 | GGATTCCATGAGGTGCGCGA | 3132 |
| FANCF_2B_-17 | GCTGCAGAAGGGATTCCATG | 3133 |
| FANCF_2B_+21 | GCTTGAGACCGCCAGAAGCT | 3134 |
| FANCF_2B_+48 | GGGGTCCCAGGTGCTGACGT | 3135 |
| HEK3_2B_-108 | GCAGAAATAGACTAATTGCA | 3136 |
| HEK3_2B_-38 | GGATTGACCCAGGCCAGGGC | 3137 |
| HEK3_2B_+26 | GACGCCCTCTGGAGGAAGCA | 3138 |
| HEK3_2B_+37 | GCTGTCCTGCGACGCCCTC | 3139 |
| HEK3_2B_+63 | GCACATACTAGCCCCTGTCT | 3140 |
| HEK3_2B_+90 | GTCAACCAGTATCCCGGTGC | 3141 |
| HEK4_2B_-95 | TCCCTTCCTTCCACCCAGCC | 3142 |
| HEK4_2B_-51 | CCCTGCCTGTCATCCTGCTT | 3143 |
| HEK4_2B_-26 | GCAGTGCCACCGGGGCGCCG | 3144 |
| HEK4_2B_+52 | GCGGGGGCTCAGAGAGGGCA | 3145 |
| HEK4_2B_+74 | GAGACACACACACAGGCCTGG | 3146 |
| RNF2_2C_+41 | GTCAACCATTAAGCAAAACAT | 3147 |
| RNF2_2C_4ATOC_+5 | GTGAGTTACAACGAACACCGC | 3148 |
| RNF2_2C_4ATOG_+5 | GTGAGTTACAACGAACACCCC | 3149 |
| FANCF_2C_+48 | GGGGTCCCAGGTGCTGACGT | 3150 |
| FANCF_2C_5GTOT_+7 | GAAGCTCGGAAAAGCGATCA | 3151 |
| FANCF_2C_7ATOC_+7 | GAAGCTCGGAAAAGCGAGCC | 3152 |
| HEK3_2C_+90 | GTCAACCAGTATCCCGGTGC | 3153 |

TABLE 3D

FIGs. 41A-41K PEgRNA

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| HEK3_4A_1TTOA | GGCCCAGACTGAGCACGTGA | TCTGCCATCTCGTGCTCAGTCTG | 13 | 10 |
| HEK3_4A_1TTOC | GGCCCAGACTGAGCACGTGA | TCTGCCATCGCGTGCTCAGTCTG | 13 | 10 |
| HEK3_4A_1TTOG | GGCCCAGACTGAGCACGTGA | TCTGCCATCCCGTGCTCAGTCTG | 13 | 10 |
| HEK3_4A_2GTOA | GGCCCAGACTGAGCACGTGA | TCTGCCATTACGTGCTCAGTCTG | 13 | 10 |
| HEK3_4A_2GTOC | GGCCCAGACTGAGCACGTGA | TCTGCCATGACGTGCTCAGTCTG | 13 | 10 |
| HEK3_4A_2GTOT | GGCCCAGACTGAGCACGTGA | TCTGCCATAACGTGCTCAGTCTG | 13 | 10 |
| HEK3_4A_3ATOC | GGCCCAGACTGAGCACGTGA | TCTGCCAGCACGTGCTCAGTCTG | 13 | 10 |
| HEK3_4A_3ATOG | GGCCCAGACTGAGCACGTGA | TCTGCCACCACGTGCTCAGTCTG | 13 | 10 |
| HEK3_4A_3ATOT | GGCCCAGACTGAGCACGTGA | TCTGCCAACACGTGCTCAGTCTG | 13 | 10 |
| HEK3_4A_4TTOA | GGCCCAGACTGAGCACGTGA | TCTGCCTTCACGTGCTCAGTCTG | 13 | 10 |
| HEK3_4A_4TTOC | GGCCCAGACTGAGCACGTGA | TCTGCCGTCACGTGCTCAGTCTG | 13 | 10 |
| HEK3_4A_4TTOG | GGCCCAGACTGAGCACGTGA | TCTGCCCTCACGTGCTCAGTCTG | 13 | 10 |
| HEK3_4A_5GTOA | GGCCCAGACTGAGCACGTGA | TCTGCTATCACGTGCTCAGTCTG | 13 | 10 |
| HEK3_4A_5GTOC | GGCCCAGACTGAGCACGTGA | TCTGCGATCACGTGCTCAGTCTG | 13 | 10 |
| HEK3_4A_5GTOT | GGCCCAGACTGAGCACGTGA | TCTGCAATCACGTGCTCAGTCTG | 13 | 10 |
| HEK3_4A_6GTOA | GGCCCAGACTGAGCACGTGA | TCTGTCATCACGTGCTCAGTCTG | 13 | 10 |
| HEK3_4A_6GTOC | GGCCCAGACTGAGCACGTGA | TCTGGCATCACGTGCTCAGTCTG | 13 | 10 |
| HEK3_4A_6GTOT | GGCCCAGACTGAGCACGTGA | TCTGACATCACGTGCTCAGTCTG | 13 | 10 |
| HEK3_4A_7CTOA | GGCCCAGACTGAGCACGTGA | TCTTCCATCACGTGCTCAGTCTG | 13 | 10 |
| HEK3_4A_7CTOG | GGCCCAGACTGAGCACGTGA | TCTCCCATCACGTGCTCAGTCTG | 13 | 10 |
| HEK3_4A_7CTOT | GGCCCAGACTGAGCACGTGA | TCTACCATCACGTGCTCAGTCTG | 13 | 10 |
| HEK3_4A_8ATOC | GGCCCAGACTGAGCACGTGA | TCGGCCATCACGTGCTCAGTCTG | 13 | 10 |
| HEK3_4A_8ATOG | GGCCCAGACTGAGCACGTGA | TCCGCCATCACGTGCTCAGTCTG | 13 | 10 |
| HEK3_4A_8ATOT | GGCCCAGACTGAGCACGTGA | TCAGCCATCACGTGCTCAGTCTG | 13 | 10 |

TABLE 3D-continued

FIGs. 41A-41K PEgRNA

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| HEK3_4B_1TTOA | GGCCCAGACTGAGCACGTGA | TGGAGGAAGCAGGGCTTCCTTTCCTCTGCCATCTCGTGCTCAGTCTG | 13 | 34 |
| HEK3_4B_12GTOC | GGCCCAGACTGAGCACGTGA | TGGAGGAAGCAGGGCTTCCTTTGCTCTGCCATCACGTGCTCAGTCTG | 13 | 34 |
| HEK3_4B_14ATOT | GGCCCAGACTGAGCACGTGA | TGGAGGAAGCAGGGCTTCCTATCCTCTGCCATCACGTGCTCAGTCTG | 13 | 34 |
| HEK3_4B_17GTOC | GGCCCAGACTGAGCACGTGA | TGGAGGAAGCAGGGGTTGCTTTCCTCTGCCATCACGTGCTCAGTCTG | 13 | 34 |
| HEK3_4B_20GTOC | GGCCCAGACTGAGCACGTGA | TGGAGGAAGCACGGCTTCCTTTCCTCTGCCATCACGTGCTCAGTCTG | 13 | 34 |
| HEK3_4B_23CTOG | GGCCCAGACTGAGCACGTGA | TGGAGGAAGCTGGGCTTCCTTTCCTCTGCCATCACGTGCTCAGTCTG | 13 | 34 |
| HEK3_4B_24TTOA | GGCCCAGACTGAGCACGTGA | TGGAGGAACCAGGGCTTCCTTTCCTCTGCCATCACGTGCTCAGTCTG | 13 | 34 |
| HEK3_4B_26CTOG | GGCCCAGACTGAGCACGTGA | TGGACGAAGCAGGGCTTCCTTTCCTCTGCCATCACGTGCTCAGTCTG | 13 | 34 |
| HEK3_4B_30CTOG | GGCCCAGACTGAGCACGTGA | TCGAGGAAGCAGGGCTTCCTTTCCTCTGCCATCACGTGCTCAGTCTG | 13 | 34 |
| HEK3_4B_33CTOG | GGCCCAGACTGAGCACGTGA | TCGAGGAAGCAGGGCTTCCTTTCCTCTGCCATCACGTGCTCAGTCTG | 13 | 34 |
| RNF2_4C_1CTOA | GTCATCTTAGTCATTACCTG | AACGAACACCTCATGTAATGACTAAGATG | 15 | 14 |
| RNF2_4C_1CTOG | GTCATCTTAGTCATTACCTG | AACGAACACCTCACGTAATGACTAAGATG | 15 | 14 |
| RNF2_4C_1CTOT | GTCATCTTAGTCATTACCTG | AACGAACACCTCAAGTAATGACTAAGATG | 15 | 14 |
| RNF2_4C_2TTOA | GTCATCTTAGTCATTACCTG | AACGAACACCTCTGGTAATGACTAAGATG | 15 | 14 |
| RNF2_4C_2TTOG | GTCATCTTAGTCATTACCTG | AACGAACACCTCCGGTAATGACTAAGATG | 15 | 14 |
| RNF2_4C_3GTOC | GTCATCTTAGTCATTACCTG | AACGAACACCTGAGGTAATGACTAAGATG | 15 | 14 |
| RNF2_4C_4ATOC | GTCATCTTAGTCATTACCTG | AACGAACACCGCAGGTAATGACTAAGATG | 15 | 14 |
| RNF2_4C_4ATOT | GTCATCTTAGTCATTACCTG | AACGAACACCACAGGTAATGACTAAGATG | 15 | 14 |
| RNF2_4C_4ATOG | GTCATCTTAGTCATTACCTG | AACGAACACCCCAGGTAATGACTAAGATG | 15 | 14 |
| RNF2_4C_5GTOT | GTCATCTTAGTCATTACCTG | AACGAACACATCAGGTAATGACTAAGATG | 15 | 14 |
| RNF2_4C_6GTOA | GTCATCTTAGTCATTACCTG | AACGAACATCTCAGGTAATGACTAAGATG | 15 | 14 |

TABLE 3D-continued

FIGs. 41A-41K PEgRNA

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| RNF2_4C_7TTOC | GTCATCTTAGTCATTACCTG | AACGAACGCCTCAGGTAATGACTAAGATG | 15 | 14 |
| FANCF_4D_1ATOG | GGAATCCCTTCTGCAGCACC | GGAAAAGCGATCCAGGCGCTGCAGAAGGGAT | 14 | 17 |
| FANCF_4D_1ATOT | GGAATCCCTTCTGCAGCACC | GGAAAAGCGATCCAGGAGCTGCAGAAGGGAT | 14 | 17 |
| FANCF_4D_2CTOA | GGAATCCCTTCTGCAGCACC | GGAAAAGCGATCCAGTTGCTGCAGAAGGGAT | 14 | 17 |
| FANCF_4D_3CTOG | GGAATCCCTTCTGCAGCACC | GGAAAAGCGATCCACGTGCTGCAGAAGGGAT | 14 | 17 |
| FANCF_4D_3CTOT | GGAATCCCTTCTGCAGCACC | GGAAAAGCGATCCAAGTGCTGCAGAAGGGAT | 14 | 17 |
| FANCF_4D_4TTOA | GGAATCCCTTCTGCAGCACC | GGAAAAGCGATCCTGGTGCTGCAGAAGGGAT | 14 | 17 |
| FANCF_4D_4TTOG | GGAATCCCTTCTGCAGCACC | GGAAAAGCGATCCGGTGCTGCAGAAGGGAT | 14 | 17 |
| FANCF_4D_5GTOA | GGAATCCCTTCTGCAGCACC | GGAAAAGCGATCTAGGTGCTGCAGAAGGGAT | 14 | 17 |
| FANCF_4D_6GTOC | GGAATCCCTTCTGCAGCACC | GGAAAAGCGATGCAGGTGCTGCAGAAGGGAT | 14 | 17 |
| FANCF_4D_7ATOC | GGAATCCCTTCTGCAGCACC | GGAAAAGCGAGCCAGGTGCTGCAGAAGGGAT | 14 | 17 |
| FANCF_4D_8TTOC | GGAATCCCTTCTGCAGCACC | GGAAAAGCGGTCCAGGTGCTGCAGAAGGGAT | 14 | 17 |
| FANCF_4D_10GTOT | GGAATCCCTTCTGCAGCACC | GGAAAAGAGATCCAGGTGCTGCAGAAGGGAT | 14 | 17 |
| EMX1_4E_2ATOC | GAGTCCGAGCAGAAGAAGAA | GTGATGGGAGCCCTGCTTCTTCTGCTCGGA | 14 | 16 |
| EMX1_4E_2ATOT | GAGTCCGAGCAGAAGAAGAA | GTGATGGGAGCCCTACTTCTTCTGCTCGGA | 14 | 16 |
| EMX1_4E_3ATOG | GAGTCCGAGCAGAAGAAGAA | GTGATGGGAGCCCCTCTTCTTCTGCTCGGA | 14 | 16 |
| EMX1_4E_4GTOC | GAGTCCGAGCAGAAGAAGAA | GTGATGGGAGCCGTTCTTCTTCTGCTCGGA | 14 | 16 |
| EMX1_4E_5GTOA | GAGTCCGAGCAGAAGAAGAA | GTGATGGGAGCTCTTCTTCTTCTGCTCGGA | 14 | 16 |
| EMX1_4E_5GTOT | GAGTCCGAGCAGAAGAAGAA | GTGATGGGAGCACTTCTTCTTCTGCTCGGA | 14 | 16 |
| EMX1_4E_7CTOA | GAGTCCGAGCAGAAGAAGAA | GTGATGGGATCCCTTCTTCTTCTGCTCGGA | 14 | 16 |
| EMX1_4E_8TTOA | GAGTCCGAGCAGAAGAAGAA | GTGATGGGTGCCCTTCTTCTTCTGCTCGGA | 14 | 16 |
| EMX1_4E_8TTOC | GAGTCCGAGCAGAAGAAGAA | GTGATGGGGGCCCTTCTTCTTCTGCTCGGA | 14 | 16 |
| EMX1_4E_8TTOG | GAGTCCGAGCAGAAGAAGAA | GTGATGGGCGCCCTTCTTCTTCTGCTCGGA | 14 | 16 |
| EMX1_4E_9CTOG | GAGTCCGAGCAGAAGAAGAA | GTGATGGCAGCCCTTCTTCTTCTGCTCGGA | 14 | 16 |

TABLE 3D-continued

FIGs. 41A-41K PEgRNA

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| EMX1_4E_9CTOT | GAGTCCGAGCAGAAGAAGAA | GTGATGGAAGCCCTTCTTCTTCTGCTCGGA | 14 | 16 |
| RUNX1_4F_1CTOA | GCATTTTCAGGAGGAAGCGA | TGTCTGAAGCCATCTCTTCCTCCTGAAAAT | 15 | 15 |
| RUNX1_4F_1CTOG | GCATTTTCAGGAGGAAGCGA | TGTCTGAAGCCATCCCTTCCTCCTGAAAAT | 15 | 15 |
| RUNX1_4F_1CTOT | GCATTTTCAGGAGGAAGCGA | TGTCTGAAGCCATCACTTCCTCCTGAAAAT | 15 | 15 |
| RUNX1_4F_2GTOA | GCATTTTCAGGAGGAAGCGA | TGTCTGAAGCCATTGCTTCCTCCTGAAAAT | 15 | 15 |
| RUNX1_4F_3ATOC | GCATTTTCAGGAGGAAGCGA | TGTCTGAAGCCAGCGCTTCCTCCTGAAAAT | 15 | 15 |
| RUNX1_4F_3ATOG | GCATTTTCAGGAGGAAGCGA | TGTCTGAAGCCACCGCTTCCTCCTGAAAAT | 15 | 15 |
| RUNX1_4F_3ATOT | GCATTTTCAGGAGGAAGCGA | TGTCTGAAGCCAACGCTTCCTCCTGAAAAT | 15 | 15 |
| RUNX1_4F_4TTOA | GCATTTTCAGGAGGAAGCGA | TGTCTGAAGCCTTCGCTTCCTCCTGAAAAT | 15 | 15 |
| RUNX1_4F_4TTOC | GCATTTTCAGGAGGAAGCGA | TGTCTGAAGCCGTCGCTTCCTCCTGAAAAT | 15 | 15 |
| RUNX1_4F_4TTOG | GCATTTTCAGGAGGAAGCGA | TGTCTGAAGCCCTCGCTTCCTCCTGAAAAT | 15 | 15 |
| RUNX1_4F_5GTOT | GCATTTTCAGGAGGAAGCGA | TGTCTGAAGCAATCGCTTCCTCCTGAAAAT | 15 | 15 |
| RUNX1_4F_6GTOC | GCATTTTCAGGAGGAAGCGA | TGTCTGAAGGCATCGCTTCCTCCTGAAAAT | 15 | 15 |
| VEGFA_4G_1TTOA | GATGTCTGCAGGCCAGATGA | AATGTGCCATCTGGAGCCCTCTTCTGGCCTGCAGA | 13 | 22 |
| VEGFA_4G_1TTOC | GATGTCTGCAGGCCAGATGA | AATGTGCCATCTGGAGCCCTCGTCTGGCCTGCAGA | 13 | 22 |
| VEGFA_4G_1TTOG | GATGTCTGCAGGCCAGATGA | AATGTGCCATCTGGAGCCCTCCTCTGGCCTGCAGA | 13 | 22 |
| VEGFA_4G_2GTOA | GATGTCTGCAGGCCAGATGA | AATGTGCCATCTGGAGCCCTTATCTGGCCTGCAGA | 13 | 22 |
| VEGFA_4G_3ATOC | GATGTCTGCAGGCCAGATGA | AATGTGCCATCTGGAGCCCGCATCTGGCCTGCAGA | 13 | 22 |
| VEGFA_4G_3ATOG | GATGTCTGCAGGCCAGATGA | AATGTGCCATCTGGAGCCCCCATCTGGCCTGCAGA | 13 | 22 |
| VEGFA_4G_3ATOT | GATGTCTGCAGGCCAGATGA | AATGTGCCATCTGGAGCCCACATCTGGCCTGCAGA | 13 | 22 |
| VEGFA_4G_5GTOT | GATGTCTGCAGGCCAGATGA | AATGTGCCATCTGGAGCACTCATCTGGCCTGCAGA | 13 | 22 |
| VEGFA_4G_6GTOC | GATGTCTGCAGGCCAGATGA | AATGTGCCATCTGGAGGCCTCATCTGGCCTGCAGA | 13 | 22 |
| VEGFA_4G_7CTOA | GATGTCTGCAGGCCAGATGA | AATGTGCCATCTGGATCCCTCATCTGGCCTGCAGA | 13 | 22 |
| VEGFA_4G_7CTOT | GATGTCTGCAGGCCAGATGA | AATGTGCCATCTGGAACCCTCATCTGGCCTGCAGA | 13 | 22 |

TABLE 3D-continued

| FIGs. 41A-41K PEgRNA | | | | |
|---|---|---|---|---|
| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
| VEGFA_4G_9CTOG | GATGTCTGCAGGCCAGATGA | AATGTGCCATCTGCAGCCCTCATCTGGCCTGCAGA | 13 | 22 |
| DNMT1_4H_1ATOC | GATTCCTGGTGCCAGAAACA | GTCACCCCTGGTTCTGGCACCAGG | 13 | 11 |
| DNMT1_4H_1ATOG | GATTCCTGGTGCCAGAAACA | GTCACCCCTGCTTCTGGCACCAGG | 13 | 11 |
| DNMT1_4H_2CTOA | GATTCCTGGTGCCAGAAACA | GTCACCCCTTTTTCTGGCACCAGG | 13 | 11 |
| DNMT1_4H_2CTOG | GATTCCTGGTGCCAGAAACA | GTCACCCCTCTTTCTGGCACCAGG | 13 | 11 |
| DNMT1_4H_2CTOT | GATTCCTGGTGCCAGAAACA | GTCACCCCTATTTCTGGCACCAGG | 13 | 11 |
| DNMT1_4H_3ATOT | GATTCCTGGTGCCAGAAACA | GTCACCCCAGTTTCTGGCACCAGG | 13 | 11 |
| DNMT1_4H_4GTOA | GATTCCTGGTGCCAGAAACA | GTCACCCTTGTTTCTGGCACCAGG | 13 | 11 |
| DNMT1_4H_5GTOT | GATTCCTGGTGCCAGAAACA | GTCACCACTGTTTCTGGCACCAGG | 13 | 11 |
| DNMT1_4H_6GTOC | GATTCCTGGTGCCAGAAACA | GTCACGCCTGTTTCTGGCACCAGG | 13 | 11 |
| DNMT1_4H_8TTOA | GATTCCTGGTGCCAGAAACA | GCCCTCCCGTCTCCCCTGTTTCTGGCACCAGG | 13 | 19 |
| DNMT1_4H_8TTOC | GATTCCTGGTGCCAGAAACA | GCCCTCCCGTCGCCCCTGTTTCTGGCACCAGG | 13 | 19 |
| DNMT1_4H_8TTOG | GATTCCTGGTGCCAGAAACA | GCCCTCCCGTCCCCCCTGTTTCTGGCACCAGG | 13 | 19 |
| HEK3_4JDEL1_5 | GGCCCAGACTGAGCACGTGA | TGGAGGAAGCAGGGCTTCCTTTCCTCTGCCGTGCTCAGTCTG | 13 | 29 |
| HEK3_4JDEL_1_10 | GGCCCAGACTGAGCACGTGA | TGGAGGAAGCAGGGCTTCCTTTCCCGTGCTCAGTCTG | 13 | 24 |
| HEK3_4JDEL_1_15 | GGCCCAGACTGAGCACGTGA | TGGAGGAAGCAGGGCTTCCCGTGCTCAGTCTG | 13 | 19 |
| HEK3_4J_DEL1_25_ | GGCCCAGACTGAGCACGTGA | TGTCCTGCGACGCCCTCTGGAGGAAGCGTGCTCAGTCTG | 13 | 26 |
| HEK3_4J_DEL1_30 | GGCCCAGACTGAGCACGTGA | TGTCCTGCGACGCCCTCTGGACGTGCTCAGTCTG | 13 | 21 |
| HEK3_4J_DEL1_80 | GGCCCAGACTGAGCACGTGA | AGTATCCCGGTGCAGGAGCTCGTGCTCAGTCTG | 13 | 20 |
| HEK3_4I_1AINS | GGCCCAGACTGAGCACGTGA | TCTGCCATCATCGTGCTCAGTCTG | 13 | 11 |
| HEK3_4I_1CTTINS | GGCCCAGACTGAGCACGTGA | TCTGCCATCAAAGCGTGCTCAGTCTG | 13 | 13 |
| HEK3_4I_1TDEL | GGCCCAGACTGAGCACGTGA | TCTGCCATCCGTGCTCAGTCTG | 13 | 9 |
| HEK3_4I_1-3TGADEL | GGCCCAGACTGAGCACGTGA | TGGAGGAAGCAGGGCTTCCTTTCCTCTGCCACGTGCTCAGTCTG | 13 | 31 |

TABLE 3D-continued

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| RNF2_4I_1 TINS | GTCATCTTAGTCATT ACCTG | AACGAACACCTCAGAGT AATGACTAAGATG | 15 | 15 |
| RNF2_4I_1 GTAINS | GTCATCTTAGTCATT ACCTG | AACGAACACCTCAGTAC GTAATGACTAAGATG | 15 | 17 |
| RNF2_4I_4 ADEL | GTCATCTTAGTCATT ACCTG | AACGAACACCCAGGTAA TGACTAAGATG | 15 | 13 |
| RNF2_4I_3 -5GAGDEL | GTCATCTTAGTCATT ACCTG | AACGAACACAGGTAATG ACTAAGATG | 15 | 11 |
| FANCF_4I_ 3CINS | GGAATCCCTTCTGC AGCACC | GGAAAAGCGATCCAGGG TGCTGCAGAAGGGAT | 14 | 18 |
| FANCF_4I_ 4GATINS | GGAATCCCTTCTGC AGCACC | GGAAAAGCGATCCAATC GGTGCTGCAGAAGGGAT | 14 | 20 |
| FANCF_4I_ 6GDEL | GGAATCCCTTCTGC AGCACC | GGAAAAGCGATCAGGTG CTGCAGAAGGGAT | 14 | 16 |
| FANCF_4I_ 5- 7GGADEL | GGAATCCCTTCTGC AGCACC | GGAAAAGCGAAGGTGCT GCAGAAGGGAT | 14 | 14 |
| EMX1_4I_6 TINS | GAGTCCGAGCAGA AGAAGAA | GTGATGGGAGCACCTTCT TCTTCTGCTCGGA | 14 | 17 |
| EMX1_4I_1 TGCINS | GAGTCCGAGCAGA AGAAGAA | GTGATGGGAGCCCTTCGC ATTCTTCTGCTCGGA | 14 | 19 |
| EMX1_4I_5 GDEL | GAGTCCGAGCAGA AGAAGAA | GTGATGGGAGCCTTCTTC TTCTGCTCGGA | 14 | 15 |
| EMX1_4I_4 -6GGGDEL | GAGTCCGAGCAGA AGAAGAA | GTGATGGGAGTTCTTCTT CTGCTCGGA | 14 | 13 |
| RUNX1_4I _1CINS | GCATTTTCAGGAGG AAGCGA | TGTCTGAAGCCATCGGCT TCCTCCTGAAAAT | 15 | 16 |
| RUNX1_4I _1ATGINS | GCATTTTCAGGAGG AAGCGA | TGTCTGAAGCCATCCATG CTTCCTCCTGAAAAT | 15 | 18 |
| RUNX1_4I _2GDEL | GCATTTTCAGGAGG AAGCGA | TGTCTGAAGCCATGCTTC CTCCTGAAAAT | 15 | 14 |
| RUNX1_4I 2- 4GATDEL | GCATTTTCAGGAGG AAGCGA | TGTCTGAAGCCGCTTCCT CCTGAAAAT | 15 | 12 |
| VEGFA_4I _4CINS | GATGTCTGCAGGCC AGATGA | AATGTGCCATCTGGAGCC GCTCATCTGGCCTGCAGA | 13 | 23 |
| VEGFA_4I _2ACAINS | GATGTCTGCAGGCC AGATGA | AATGTGCCATCTGGAGCC CTTGTCATCTGGCCTGCA GA | 13 | 25 |
| VEGFA_4I _3ADEL | GATGTCTGCAGGCC AGATGA | AATGTGCCATCTGGAGCC CCATCTGGCCTGCAGA | 13 | 21 |
| VEGFA_4I 2- 4GAGDEL | GATGTCTGCAGGCC AGATGA | AATGTGCCATCTGGAGCC ATCTGGCCTGCAGA | 13 | 19 |
| DNMT1_4I _4CINS | GATTCCTGGTGCCA GAAACA | TCCCGTCACCCGCTGTTT CTGGCACCAGG | 13 | 16 |

TABLE 3D-continued

FIGs. 41A-41K PEgRNA

| PEGRNA | SPACER SEQUENCE (SEQ ID NO: 3154-3304) | 3' EXTENSION (SEQ ID NOS: 3305-3455) | PBS LENGTH (NT) | RT TEMPLATE LENGTH (NT) |
|---|---|---|---|---|
| DNMT1_4I_1TCAINS | GATTCCTGGTGCCA GAAACA | TCCCGTCACCCCTGTGAT TTCTGGCACCAGG | 13 | 18 |
| DNMT1_4I_3ADEL | GATTCCTGGTGCCA GAAACA | TCCCGTCACCCCGTTTCT GGCACCAGG | 13 | 14 |
| DNMT1_4I_3-5AGGDEL | GATTCCTGGTGCCA GAAACA | TCCCGTCACCGTTTCTGG CACCAGG | 13 | 12 |
| HEK3_4K_1CTTINS_5GDEL | GGCCCAGACTGAG CACGTGA | TGGAGGAAGCAGGGCTT CCTTTCCTCTGCATCAAA GCGTGCTCAGTCTG | 13 | 36 |
| HEK3_4K_1CTTINS_2GTOC | GGCCCAGACTGAG CACGTGA | TGGAGGAAGCAGGGCTT CCTTTCCTCTGCCATGAA AGCGTGCTCAGTCTG | 13 | 37 |
| HEK3_4K_3TDEL_5GTOC | GGCCCAGACTGAG CACGTGA | TGGAGGAAGCAGGGCTT CCTTTCCTCTGCGATCCG TGCTCAGTCTG | 13 | 33 |
| HEK3_4K_3GTOC_6GTOT | GGCCCAGACTGAG CACGTGA | TGGAGGAAGCAGGGCTT CCTTTCCTCTGACATGAC GTGCTCAGTCTG | 13 | 34 |
| RNF2_4K_2AAINS_3-4GADEL | GTCATCTTAGTCATT ACCTG | AACGAACACCATTGGTA ATGACTAAGATG | 15 | 14 |
| RNF2_4K_1AINS_5GTOC | GTCATCTTAGTCATT ACCTG | AACGAACACGTCAGTGT AATGACTAAGATG | 15 | 15 |
| RNF2_4K_1-2CTDEL_6GTOT | GTCATCTTAGTCATT ACCTG | AACGAACAACTCGTAAT GACTAAGATG | 15 | 12 |
| RNF2_4K_1CTOA_5GTOT | GTCATCTTAGTCATT ACCTG | AACGAACACATCATGTAA TGACTAAGATG | 15 | 14 |
| FANCF_4K_1TINS_3-4TGDEL | GGAATCCCTTCTGC AGCACC | GGAAAAGCGATCGGTAG CTGCAGAAGGGAT | 14 | 16 |
| FANCF_4K_1TINS_6GTOA | GGAATCCCTTCTGC AGCACC | GGAAAAGCGATTCAGGT AGCTGCAGAAGGGAT | 14 | 18 |
| FANCF_4K_2CDEL_5GTOT | GGAATCCCTTCTGC AGCACC | GGAAAAGCGATCAAGTG CTGCAGAAGGGAT | 14 | 16 |

TABLE 3E

FIGs. 41A-41K nicking sgRNA

| NICKING SGRNA | SPACER SEQUENCE (SEQ ID NOS: 3456-3463) |
|---|---|
| HEK3_4A_+90 | GTCAACCAGTATCCCGGTGC |
| HEK3_4B_+90 | GTCAACCAGTATCCCGGTGC |
| RNF2_4C_+41 | GTCAACCATTAAGCAAAACAT |
| FANCF_4D_+48 | GGGGTCCCAGGTGCTGACGT |
| EMX1_4E_+53 | GACATCGATGTCCTCCCCAT |
| RUNX1_4F_+38 | GATGAAGCACTGTGGGTACGA |
| VEGFA_4G_+57 | GATGTACAGAGAGCCCAGGGC |
| DNMT1_4H_+49 | GCCCTTCAGCTAAAATAAAGG |

TABLE 3F

FIGs. 42A-42H PEgRNA

| PEGRNA | SPACER SEQUENCE (SEQ ID NO: 3464-3478) | 3' EXTENSION (SEQ ID NOS: 3479-3493) | PBS LENGTH (NT) | RT TEMPLATE LENGTH (NT) |
|---|---|---|---|---|
| HEK3_5A_C3 | GGCCCAGACTGAGCACGTGA | TCTGTCATCACGTGCTCAGTCTG | 13 | 10 |
| HEK3_5A_C4 | GGCCCAGACTGAGCACGTGA | TCTGCTATCACGTGCTCAGTCTG | 13 | 10 |
| HEK3_5A_C7 | GGCCCAGACTGAGCACGTGA | TCTGCCATTACGTGCTCAGTCTG | 13 | 10 |
| FANCF_5A_C3 | GGAATCCCTTCTGCAGCACC | GGAAAAGTGATCCAGGTGCTGCAGAAGGGAT | 14 | 17 |
| FANCF_5A_C7 | GGAATCCCTTCTGCAGCACC | GGAAAAGCGATTCAGGTGCTGCAGAAGGGAT | 14 | 17 |
| FANCF_5A_C8 | GGAATCCCTTCTGCAGCACC | GGAAAAGCGATCTAGGTGCTGCAGAAGGGAT | 14 | 17 |
| EMX1_5A_C5 | GAGTCCGAGCAGAAGAAGAA | GTGATGGGAGTCCTTCTTCTTCTGCTCGGA | 14 | 16 |
| EMX1_5A_C6 | GAGTCCGAGCAGAAGAAGAA | GTGATGGGAGCTCTTCTTCTTCTGCTCGGA | 14 | 16 |
| EMX1_5A_C7 | GAGTCCGAGCAGAAGAAGAA | GTGATGGGAGCCTTTCTTCTTCTGCTCGGA | 14 | 16 |
| EMX1_5C_C5_6 | GAGTCCGAGCAGAAGAAGAA | GTGATGGGAGTTCTTCTTCTTCTGCTCGGA | 14 | 16 |
| EMX1_5C_C5_7 | GAGTCCGAGCAGAAGAAGAA | GTGATGGGAGTCTTTCTTCTTCTGCTCGGA | 14 | 16 |
| EMX1_5C_C6_7 | GAGTCCGAGCAGAAGAAGAA | GTGATGGGAGCTTTTCTTCTTCTGCTCGGA | 14 | 16 |
| EMX1_5C_C5_6_7 | GAGTCCGAGCAGAAGAAGAA | GTGATGGGAGTTTTTCTTCTTCTGCTCGGA | 14 | 16 |
| HEK3_5D_A5 | GGCCCAGACTGAGCACGTGA | TCTGCCGTCACGTGCTCAGTCTG | 13 | 10 |
| HEK3_5D_A8 | GGCCCAGACTGAGCACGTGA | TCTGCCATCGCGTGCTCAGTCTG | 13 | 10 |

TABLE 3G

FIGs. 42A-42H nicking sgRNA

| NICKING SGRNA | POSSIBLE SPACER SEQUENCE (SEQ ID NOS: 616-618) | POSSIBLE SPACER SEQUENCE (SEQ ID NOS: 619-621) |
|---|---|---|
| HEK3_5A-F_+90 | GTCAACCAGTATCCCGGTGC | GTCAACCAGTATCCCGGTGC |
| FANCF_5A-F_+48 | GGGGTCCCAGGTGCTGACGT | GATGTACAGAGAGCCCAGGGC |
| EMX1_5A-F_+57 | GATGTACAGAGAGCCCAGGGC | GGGGTCCCAGGTGCTGACGT |

TABLE 3H

FIGs. 42A-42H base editing sgRNA

| BASE EDITING SGRNA | SPACER SEQUENCE |
|---|---|
| HEK3_5A-F_BE | GTGCCATCACGTGCTCAGTCT (SEQ ID NO: 455) |
| FANCF_5A-F_BE | GAGCGATCCAGGTGCTGCAGA (SEQ ID NO: 456) |
| EMX1_5A-F_BE | GGAGCCCTTCTTCTTCTGCT (SEQ ID NO: 457) |

TABLE 3I

FIGs. 42A-42H on-target sgRNA

| ON-TARGET SGRNA | SPACER SEQUENCE |
|---|---|
| HEK3_5G | GGCCCAGACTGAGCACGTGA (SEQ ID NO: 510) |
| HEK4_5G | GGCACTGCGGCTGGAGGTGG (SEQ ID NO: 511) |
| EMX1_5G | GAGTCCGAGCAGAAGAAGAA (SEQ ID NO: 512) |
| FANCF_5G | GGAATCCCTTCTGCAGCACC (SEQ ID NO: 513) |

TABLE 3J

FIGs. 42A-42H on-target PEgRNA

| ON-TARGET PEGRNA | SPACER SEQUENCE (SEQ ID NO: 663-677) | 3' EXTENSION (SEQ ID NO: 678-692) | PBS LENGTH (NT) | RT TEMPLATE LENGTH (NT) |
|---|---|---|---|---|
| HEK3_5G-H_PEGRNA_1 | GGCCCAGACTGAGCACGTGA | TCTGCCATCTCGTGCTCAGTCTG | 13 | 10 |
| HEK3_5G-H_PEGRNA_2 | GGCCCAGACTGAGCACGTGA | TCTGCCATCAAAGCGTGCTCAGTCTG | 13 | 13 |
| HEK3_5G-H_PEGRNA_3 | GGCCCAGACTGAGCACGTGA | TCTGCCATCCGTGCTCAGTCTG | 13 | 9 |
| HEK3_5G-H_PEGRNA_4 | GGCCCAGACTGAGCACGTGA | TCTGCGATCACGTGCTCAGTCTG | 13 | 10 |
| HEK4_5G-H_PEGRNA_1 | GGCACTGCGGCTGGAGGTGG | TTAACGCCCACCTCCAGCC | 9 | 10 |
| HEK4_5G-H_PEGRNA_2 | GGCACTGCGGCTGGAGGTGG | TTAACCCCCCCCTCCAGCC | 9 | 10 |
| HEK4_5G-H_PEGRNA_3 | GGCACTGCGGCTGGAGGTGG | TTAACCCCTTACACCTCCAGCC | 9 | 13 |
| HEK4_5G-H_PEGRNA_4 | GGCACTGCGGCTGGAGGTGG | TTAACCCCCCCTCCAGCC | 9 | 9 |
| EMX1_5G-H_PEGRNA_1 | GAGTCCGAGCAGAAGAAGAA | GTGATGGGAGCACTTCTTCTTCTGCTCGGA | 14 | 16 |
| EMX1_5G-H_PEGRNA_2 | GAGTCCGAGCAGAAGAAGAA | GTGATGGGAGCCCTGCTTCTTCTGCTCGGA | 14 | 16 |
| EMX1_5G-H_PEGRNA_3 | GAGTCCGAGCAGAAGAAGAA | GTGATGGGAGCCCTTCGCATTCTTCTGCTCGGA | 14 | 19 |
| EMX1_5G-H_PEGRNA_4 | GAGTCCGAGCAGAAGAAGAA | GTGATGGGAGTTCTTCTTCTGCTCGGA | 14 | 13 |
| FANCF_5G-H_PEGRNA_1 | GGAATCCCTTCTGCAGCACC | GGAAAAGCGATGCAGGTGCTGCAGAAGGGAT | 14 | 17 |
| FANCF_5G-H_PEGRNA_2 | GGAATCCCTTCTGCAGCACC | GGAAAAGCGATCCAGGCGCTGCAGAAGGGAT | 14 | 17 |
| FANCF_5G-H_PEGRNA_3 | GGAATCCCTTCTGCAGCACC | GGAAAAGCGATCCAATCGGTGCTGCAGAAGGGAT | 14 | 20 |

TABLE 3K

FIGs. 49A-49BPEgRNA

| PEGRNA | SPACER SEQUENCE (SEQ ID NO: 3494-3521) | 3' EXTENSION (SEQ ID NO: 3522-3540) | PBS LENGTH) (NT) | RT TEMP- LATE LENGTH (NT) |
|---|---|---|---|---|
| HEK3_6A_2G TOC | GGCCCAGACTG AGCACGTGA | TCTGCCATGACGTGCTC AGTCTG | 13 | 10 |
| HEK3_6A_2G TOC | GGCCCAGACTG AGCACGTGA | | | |
| EMX1_6A_3G TOC | GAGTCCGAGCA GAAGAAGAA | ATGGGAGCCCTTGTTCT TCTGCTCGG | 13 | 13 |
| EMX1_6A_3G TOC | GAGTCCGAGCA GAAGAAGAA | | | |
| FANCF_6A_5 GTOT | GGAATCCCTTCT GCAGCACC | AAAAGCGATCAAGGTGC TGCAGAAGGGA | 13 | 15 |
| FANCF_6A_5 GTOT | GGAATCCCTTCT GCAGCACC | | | |
| HEK3_6A_1H IS6INS | GGCCCAGACTG AGCACGTGA | TGGAGGAAGCAGGGCTT CCTTTCCTCTGCCATCAA TGATGGTGATGATGGTG CGTGCTCAGTCTG | 13 | 52 |
| HEK3_6A_1H IS6INS | GGCCCAGACTG AGCACGTGA | | | |
| HEK3_6A_5G TOT | GGCCCAGACTG AGCACGTGA | TCTGCAATCACGTGCTC AGTCTG | 13 | 10 |
| HEK3_6A_5G TOT | GGCCCAGACTG AGCACGTGA | | | |
| HEK3_6A_1C TTINS | GGCCCAGACTG AGCACGTGA | TCTGCCATCAAAGCGTG CTCAGTCTG | 13 | 10 |
| HEK3_6A_1C TTINS | GGCCCAGACTG AGCACGTGA | | | |
| HBB_6B_INS ALL | GCATGGTGCAC CTGACTCCTG | AGACTTCTCCACAGGAG TCAGGTGCAC | 13 | 14 |
| HBB_6B_INS ALL | GCATGGTGCAC CTGACTCCTG | | | |
| HBB_6B_COR RECT | GCATGGTGCAC CTGACTCCTG | AGACTTCTCCTCAGGAG TCAGGTGCAC | 13 | 14 |
| HBB_6B_COR RECT | GCATGGTGCAC CTGACTCCTG | | | |
| HBB_6B_COR RECT_W_SIL ENT | GCATGGTGCAC CTGACTCCTG | AGACTTCTCTTCAGGAG TCAGGTGCAC | 13 | 14 |
| HBB_6B_COR RECT_W_SIL ENT | GCATGGTGCAC CTGACTCCTG | | | |
| HEXA_6B_IN STALL | GTACCTGAACC GTATATCCTA | AGTCAGGGCCATAGGAT AGATATACGGTTC | 12 | 14 |
| HEXA_6B_CO RRECT | GATCCTTCCAGT CAGGGCCAT | ACCTGAACCGTATATCCT ATGGCCCTGACTG | 10 | 21 |
| HEXA_6B_CO RRECT_W_SI LENT | GATCCTTCCAGT CAGGGCCAT | GTACCTGAACCGTATATC TTATGGCCCTGACT | 9 | 27 |
| PRNP_6C | GCAGTGGTGGG GGGCCTTGG | ATGTAGACGCCAAGGCC CCCCACC | 12 | 12 |
| HEK3_6E-G_1TTOG | GGCCCAGACTG AGCACGTGA | TCTGCCATCCCGTGCTC AGTCTG | 13 | 10 |
| HEK3_6E-G_1CTTINS | GGCCCAGACTG AGCACGTGA | TCTGCCATCAAAGCGTG CTCAGTCTG | 13 | 10 |
| RNF2_6E-G_1CTOG | GTCATCTTAGTC ATTACCTG | AACGAACACCTCACGTA ATGACTAAGATG | 15 | 14 |

TABLE 3K-continued

FIGs. 49A-49B PEgRNA

| PEGRNA | SPACER SEQUENCE (SEQ ID NO: 3494-3521) | 3' EXTENSION (SEQ ID NO: 3522-3540) | PBS LENGTH) (NT) | RT TEMP- LATE LENGTH (NT) |
|---|---|---|---|---|
| HBB_6E-G_4ATOT | GCATGGTGCAC CTGACTCCTG | AGACTTCTCCACAGGAG TCAGGTGCAC | 13 | 14 |
| HEK3_6H_1H IS6INS | GGCCCAGACTG AGCACGTGA | TGGAGGAAGCAGGGCTT CCTTTCCTCTGCCATCAA TGATGGTGATGATGGTG CGTGCTCAGTCTG | 13 | 52 |
| HEK3_6H_1F LAGINS | GGCCCAGACTG AGCACGTGA | TGGAGGAAGCAGGGCTT CCTTTCCTCTGCCATCAC TTATCGTCGTCATCCTTG TAATCCGTGCTCAGTCTG | 13 | 58 |

TABLE 3L

FIGs. 47A-74D PEqRNA

| PEGRNA | SPACER SEQUENCE (SEQ ID NO: 3541-3547) | 3' EXTENSION SEQUENCE (SEQ ID NO: 3549-3556) | PBS LENGTH) (NT) | RT TEMP- LATE LENGTH) (NT) |
|---|---|---|---|---|
| HEK3_ED4B_1 TDEL | GGCCCAGACTGAGC ACGTGA | TCTGCCATCCGTGCTCAG TCTG | 13 | 9 |
| HEK3_ED4B_1 AINS | GGCCCAGACTGAGC ACGTGA | TCTGCCATCATCGTGCTC AGTCTG | 13 | 11 |
| HEK3_ED4B_1 CTTINS | GGCCCAGACTGAGC ACGTGA | TCTGCCATCAAAGCGTGC TCAGTCTG | 13 | 13 |
| HEK3_ED4C_2 GTOC | GGCCCAGACTGAGC ACGTGA | TCTGCCATGACGTGCTCA GTCTG | 13 | 10 |
| HEK3_ED4D_1 FLAGINS | GGCCCAGACTGAGC ACGTGA | TGGAGGAAGCAGGGCTT CCTTTCCTCTGCCATCAC TTATCGTCGTCATCCTTGT AATCCGTGCTCAGTCTG | 13 | 58 |
| RNF2_ED4E_1 CTOA | GTCATCTTAGTCATT ACCTG | AACGAACACCTCATGTAA TGACTAAGATG | 15 | 14 |
| EMX1_ED4F_1 GTOC | GAGTCCGAGCAGAA GAAGAA | ATGGGAGCCCTTGTTCTT CTGCTCGG | 13 | 13 |
| HBB_ED4G_2T TOA | GTAACGGCAGACTT CTCCTC | ATCTGACTCCTGTGGAGA AGTCTGCC | 12 | 14 |

TABLE 3M

FIGs. 48A-48C PEqRNA

| PEGRNA | SPACER SEQUENCE (SEQ ID NO: 3557-3627) | 3' EXTENSION SEQUENCE (SEQ ID NO: 3549-3556) | PBS LENGTH (NT) | RT TEMPLATE LENGTH (NT) |
|---|---|---|---|---|
| VEGFA_ED 5A_31 | GATGTCTGCAGGC CAGATGA | CCCTCTGACAATGTGCCATC TGGAGCACTCATCTGGCCTG CAGA | 13 | 31 |
| VEGFA_ED 5A_30 | GATGTCTGCAGGC CAGATGA | CCTCTGACAATGTGCCATCT GGAGCACTCATCTGGCCTGC AGA | 13 | 30 |

TABLE 3M-continued

FIGs. 48A-48C PEgRNA

| PEGRNA | SPACER SEQUENCE (SEQ ID NO: 3557-3627) | 3' EXTENSION SEQUENCE (SEQ ID NO: 3549-3556) | PBS LENGTH (NT) | RT TEMPLATE LENGTH (NT) |
|---|---|---|---|---|
| VEGFA_ED 5A_29 | GATGTCTGCAGGC CAGATGA | CTCTGACAATGTGCCATCTG GAGCACTCATCTGGCCTGCA GA | 13 | 29 |
| VEGFA_ED 5A_28 | GATGTCTGCAGGC CAGATGA | TCTGACAATGTGCCATCTGG AGCACTCATCTGGCCTGCAGA | 13 | 28 |
| VEGFA_ED 5A_27 | GATGTCTGCAGGC CAGATGA | CTGACAATGTGCCATCTGGA GCACTCATCTGGCCTGCAGA | 13 | 27 |
| VEGFA_ED 5A_26 | GATGTCTGCAGGC CAGATGA | TGACAATGTGCCATCTGGAG CACTCATCTGGCCTGCAGA | 13 | 26 |
| VEGFA_ED 5A_25 | GATGTCTGCAGGC CAGATGA | GACAATGTGCCATCTGGAGC ACTCATCTGGCCTGCAGA | 13 | 25 |
| VEGFA_ED 5A_24 | GATGTCTGCAGGC CAGATGA | ACAATGTGCCATCTGGAGCA CTCATCTGGCCTGCAGA | 13 | 24 |
| VEGFA_ED 5A_23 | GATGTCTGCAGGC CAGATGA | CAATGTGCCATCTGGAGCAC TCATCTGGCCTGCAGA | 13 | 23 |
| VEGFA_ED 5A_22 | GATGTCTGCAGGC CAGATGA | AATGTGCCATCTGGAGCACT CATCTGGCCTGCAGA | 13 | 22 |
| VEGFA_ED 5A_21 | GATGTCTGCAGGC CAGATGA | ATGTGCCATCTGGAGCACTC ATCTGGCCTGCAGA | 13 | 21 |
| VEGFA_ED 5A_20 | GATGTCTGCAGGC CAGATGA | TGTGCCATCTGGAGCACTCA TCTGGCCTGCAGA | 13 | 20 |
| VEGFA_ED 5A_19 | GATGTCTGCAGGC CAGATGA | GTGCCATCTGGAGCACTCAT CTGGCCTGCAGA | 13 | 19 |
| VEGFA_ED 5A_18 | GATGTCTGCAGGC CAGATGA | TGCCATCTGGAGCACTCATC TGGCCTGCAGA | 13 | 18 |
| VEGFA_ED 5A_17 | GATGTCTGCAGGC CAGATGA | GCCATCTGGAGCACTCATCT GGCCTGCAGA | 13 | 17 |
| VEGFA_ED 5A_16 | GATGTCTGCAGGC CAGATGA | CCATCTGGAGCACTCATCTG GCCTGCAGA | 13 | 16 |
| VEGFA_ED 5A_15 | GATGTCTGCAGGC CAGATGA | CATCTGGAGCACTCATCTGG CCTGCAGA | 13 | 15 |
| VEGFA_ED 5A_14 | GATGTCTGCAGGC CAGATGA | ATCTGGAGCACTCATCTGGC CTGCAGA | 13 | 14 |
| VEGFA_ED 5A_13 | GATGTCTGCAGGC CAGATGA | TCTGGAGCACTCATCTGGCC TGCAGA | 13 | 13 |
| VEGFA_ED 5A_12 | GATGTCTGCAGGC CAGATGA | CTGGAGCACTCATCTGGCCT GCAGA | 13 | 12 |
| VEGFA_ED 5A_11 | GATGTCTGCAGGC CAGATGA | TGGAGCACTCATCTGGCCTG CAGA | 13 | 11 |
| VEGFA_ED 5A_10 | GATGTCTGCAGGC CAGATGA | GGAGCACTCATCTGGCCTGC AGA | 13 | 10 |
| VEGFA_ED 5A_9 | GATGTCTGCAGGC CAGATGA | GAGCACTCATCTGGCCTGCA GA | 13 | 9 |
| VEGFA_ED 5A_8 | GATGTCTGCAGGC CAGATGA | AGCACTCATCTGGCCTGCAGA | 13 | 8 |
| DNMT1_ED 5B_31 | GATTCCTGGTGCC AGAAACA | AGGACTAGTTCTGCCCTCCC GTCACCACTGTTTCTGGCAC CAGG | 13 | 31 |

TABLE 3M-continued

FIGs. 48A-48C PEgRNA

| PEGRNA | SPACER SEQUENCE (SEQ ID NO: 3557-3627) | 3' EXTENSION SEQUENCE (SEQ ID NO: 3549-3556) | PBS LENGTH (NT) | RT TEMPLATE LENGTH (NT) |
| --- | --- | --- | --- | --- |
| DNMT1_ED 5B_30 | GATTCCTGGTGCC AGAAACA | GGACTAGTTCTGCCCTCCCG TCACCACTGTTTCTGGCACC AGG | 13 | 30 |
| DNMT1_ED 5B_29 | GATTCCTGGTGCC AGAAACA | GACTAGTTCTGCCCTCCCGT CACCACTGTTTCTGGCACCA GG | 13 | 29 |
| DNMT1_ED 5B_28 | GATTCCTGGTGCC AGAAACA | ACTAGTTCTGCCCTCCCGTC ACCACTGTTTCTGGCACCAGG | 13 | 28 |
| DNMT1_ED 5B_27 | GATTCCTGGTGCC AGAAACA | CTAGTTCTGCCCTCCCGTCA CCACTGTTTCTGGCACCAGG | 13 | 27 |
| DNMT1_ED 5B_26 | GATTCCTGGTGCC AGAAACA | TAGTTCTGCCCTCCCGTCAC CACTGTTTCTGGCACCAGG | 13 | 26 |
| DNMT1_ED 5B_25 | GATTCCTGGTGCC AGAAACA | AGTTCTGCCCTCCCGTCACC ACTGTTTCTGGCACCAGG | 13 | 25 |
| DNMT1_ED 5B_24 | GATTCCTGGTGCC AGAAACA | GTTCTGCCCTCCCGTCACCA CTGTTTCTGGCACCAGG | 13 | 24 |
| DNMT1_ED 5B_23 | GATTCCTGGTGCC AGAAACA | TTCTGCCCTCCCGTCACCAC TGTTTCTGGCACCAGG | 13 | 23 |
| DNMT1_ED 5B_22 | GATTCCTGGTGCC AGAAACA | TCTGCCCTCCCGTCACCACT GTTTCTGGCACCAGG | 13 | 22 |
| DNMT1_ED 5B_21 | GATTCCTGGTGCC AGAAACA | CTGCCCTCCCGTCACCACTG TTTCTGGCACCAGG | 13 | 21 |
| DNMT1_ED 5B_20 | GATTCCTGGTGCC AGAAACA | TGCCCTCCCGTCACCACTGT TTCTGGCACCAGG | 13 | 20 |
| DNMT1_ED 5B_19 | GATTCCTGGTGCC AGAAACA | GCCCTCCCGTCACCACTGTT TCTGGCACCAGG | 13 | 19 |
| DNMT1_ED 5B_18 | GATTCCTGGTGCC AGAAACA | CCCTCCCGTCACCACTGTTT CTGGCACCAGG | 13 | 18 |
| DNMT1_ED 5B_17 | GATTCCTGGTGCC AGAAACA | CCTCCCGTCACCACTGTTTC TGGCACCAGG | 13 | 17 |
| DNMT1_ED 5B_16 | GATTCCTGGTGCC AGAAACA | CTCCCGTCACCACTGTTTCT GGCACCAGG | 13 | 16 |
| DNMT1_ED 5B_15 | GATTCCTGGTGCC AGAAACA | TCCCGTCACCACTGTTTCTG GCACCAGG | 13 | 15 |
| DNMT1_ED 5B_14 | GATTCCTGGTGCC AGAAACA | CCCGTCACCACTGTTTCTGG CACCAGG | 13 | 14 |
| DNMT1_ED 5B_13 | GATTCCTGGTGCC AGAAACA | CCGTCACCACTGTTTCTGGC ACCAGG | 13 | 13 |
| DNMT1_ED 5B_12 | GATTCCTGGTGCC AGAAACA | CGTCACCACTGTTTCTGGCA CCAGG | 13 | 12 |
| DNMT1_ED 5B_11 | GATTCCTGGTGCC AGAAACA | GTCACCACTGTTTCTGGCAC CAGG | 13 | 11 |
| DNMT1_ED 5B_10 | GATTCCTGGTGCC AGAAACA | TCACCACTGTTTCTGGCACC AGG | 13 | 10 |
| DNMT1_ED 5B_9 | GATTCCTGGTGCC AGAAACA | CACCACTGTTTCTGGCACCA GG | 13 | 9 |
| DNMT1_ED 5B_8 | GATTCCTGGTGCC AGAAACA | ACCACTGTTTCTGGCACCAGG | 13 | 8 |

TABLE 3M-continued

| FIGs. 48A-48C PEgRNA | | | | |
|---|---|---|---|---|
| PEGRNA | SPACER SEQUENCE (SEQ ID NO: 3557-3627) | 3' EXTENSION SEQUENCE (SEQ ID NO: 3549-3556) | PBS LENGTH (NT) | RT TEMPLATE LENGTH (NT) |
| RUNX1_ED 5C_31 | GCATTTTCAGGAG GAAGCGA | AATGACTCAAATATGCTGTC TGAAGCAATCGCTTCCTCCT GAAAAT | 15 | 31 |
| RUNX1_ED 5C_30 | GCATTTTCAGGAG GAAGCGA | ATGACTCAAATATGCTGTCT GAAGCAATCGCTTCCTCCTG AAAAT | 15 | 30 |
| RUNX1_ED 5C_29 | GCATTTTCAGGAG GAAGCGA | TGACTCAAATATGCTGTCTG AAGCAATCGCTTCCTCCTGA AAAT | 15 | 29 |
| RUNX1_ED 5C_28 | GCATTTTCAGGAG GAAGCGA | GACTCAAATATGCTGTCTGA AGCAATCGCTTCCTCCTGAA AAT | 15 | 28 |
| RUNX1_ED 5C_27 | GCATTTTCAGGAG GAAGCGA | ACTCAAATATGCTGTCTGAA GCAATCGCTTCCTCCTGAAA AT | 15 | 27 |
| RUNX1_ED 5C_26 | GCATTTTCAGGAG GAAGCGA | CTCAAATATGCTGTCTGAAG CAATCGCTTCCTCCTGAAAAT | 15 | 26 |
| RUNX1_ED 5C_25 | GCATTTTCAGGAG GAAGCGA | TCAAATATGCTGTCTGAAGC AATCGCTTCCTCCTGAAAAT | 15 | 25 |
| RUNX1_ED 5C_24 | GCATTTTCAGGAG GAAGCGA | CAAATATGCTGTCTGAAGCA ATCGCTTCCTCCTGAAAAT | 15 | 24 |
| RUNX1_ED 5C_23 | GCATTTTCAGGAG GAAGCGA | AAATATGCTGTCTGAAGCAA TCGCTTCCTCCTGAAAAT | 15 | 23 |
| RUNX1_ED 5C_22 | GCATTTTCAGGAG GAAGCGA | AATATGCTGTCTGAAGCAAT CGCTTCCTCCTGAAAAT | 15 | 22 |
| RUNX1_ED 5C_21 | GCATTTTCAGGAG GAAGCGA | ATATGCTGTCTGAAGCAATC GCTTCCTCCTGAAAAT | 15 | 21 |
| RUNX1_ED 5C_20 | GCATTTTCAGGAG GAAGCGA | TATGCTGTCTGAAGCAATCG CTTCCTCCTGAAAAT | 15 | 20 |
| RUNX1_ED 5C_19 | GCATTTTCAGGAG GAAGCGA | ATGCTGTCTGAAGCAATCGC TTCCTCCTGAAAAT | 15 | 19 |
| RUNX1_ED 5C_18 | GCATTTTCAGGAG GAAGCGA | TGCTGTCTGAAGCAATCGCT TCCTCCTGAAAAT | 15 | 18 |
| RUNX1_ED 5C_17 | GCATTTTCAGGAG GAAGCGA | GCTGTCTGAAGCAATCGCTT CCTCCTGAAAAT | 15 | 17 |
| RUNX1_ED 5C_16 | GCATTTTCAGGAG GAAGCGA | CTGTCTGAAGCAATCGCTTC CTCCTGAAAAT | 15 | 16 |
| RUNX1_ED 5C_15 | GCATTTTCAGGAG GAAGCGA | TGTCTGAAGCAATCGCTTCC TCCTGAAAAT | 15 | 15 |
| RUNX1_ED 5C_14 | GCATTTTCAGGAG GAAGCGA | GTCTGAAGCAATCGCTTCCT CCTGAAAAT | 15 | 14 |
| RUNX1_ED 5C_13 | GCATTTTCAGGAG GAAGCGA | TCTGAAGCAATCGCTTCCTC CTGAAAAT | 15 | 13 |
| RUNX1_ED 5C_12 | GCATTTTCAGGAG GAAGCGA | CTGAAGCAATCGCTTCCTCC TGAAAAT | 15 | 12 |
| RUNX1_ED 5C_11 | GCATTTTCAGGAG GAAGCGA | TGAAGCAATCGCTTCCTCCT GAAAAT | 15 | 11 |
| RUNX1_ED 5C_10 | GCATTTTCAGGAG GAAGCGA | GAAGCAATCGCTTCCTCCTG AAAAT | 15 | 10 |

TABLE 3M-continued

FIGs. 48A-48C PEgRNA

| PEGRNA | SPACER SEQUENCE (SEQ ID NO: 3557-3627) | 3' EXTENSION SEQUENCE (SEQ ID NO: 3549-3556) | PBS LENGTH (NT) | RT TEMPLATE LENGTH (NT) |
|---|---|---|---|---|
| RUNX1_ED5C_9 | GCATTTTCAGGAGGAAGCGA | AAGCAATCGCTTCCTCCTGAAAAT | 15 | 9 |

TABLE 3N

FIGS. 48A-48C PEgRNA

| PEGRNA | SPACER SEQUENCE | 3' EXTENSION SEQUENCE | PBS LENGTH (NT) | RT TEMPLATE LENGTH (NT) |
|---|---|---|---|---|
| HEK3_ED6_5GTOA | GGCCCAGACTGAGCACGTGA (SEQ ID NO: 393) | TCTGCTATCACGTGCTCAGTCTG (SEQ ID NO: 394) | 13 | 10 |

TABLE 3O

FIGS. 48A-48C nicking sgRNA

| NICKING SGRNA | SPACER SEQUENCE |
|---|---|
| HEK3_ED6_+63 | GCACATACTAGCCCCTGTCT (SEQ ID NO: 395) |

TABLE 3P

FIGS. 50A-50B PEgRNA

| PEG RNA | SPACER (SEQ ID NO: 3699-3754) | 3' EXTENSION (5' TO 3')(SEQ ID NO: 3755-3810) | PBS LENGTH (NT) | RT TEMPLATE LENGTH (NT) |
|---|---|---|---|---|
| HBB 3.5 | GTAACGGCAGACTTCTCCAC | AGACTTCTCCTCAGGAGTCAGGTGCAC | 12 | 14 |
| HBB 3.7 | GCATGGTGCACCTGACTCCTG | AGACTTCTCTTCAGGAGTCAGGTGCAC | 13 | 14 |
| HBB 5.2 | GCATGGTGCACCTGACTCCTG | TAACGGCAGACTTCTCCTCAGGAGTCAGGTGCAC | 13 | 19 |
| HBB 5.3 | GCATGGTGCACCTGACTCCTG | ACGGCAGACTTCTCCTCAGGAGTCAGGTGCAC | 13 | 17 |
| HBB 5.4 | GCATGGTGCACCTGACTCCTG | GGCAGACTTCTCCTCAGGAGTCAGGTGCAC | 13 | 16 |
| HBB 5.5 | GCATGGTGCACCTGACTCCTG | GCAGACTTCTCCTCAGGAGTCAGGTGCAC | 13 | 13 |
| HBB 5.6 | GCATGGTGCACCTGACTCCTG | GACTTCTCCTCAGGAGTCAGGTGCAC | 13 | 12 |
| HBB 5.7 | GCATGGTGCACCTGACTCCTG | ACTTCTCCTCAGGAGTCAGGTGCAC | 13 | 21 |
| HBB 5.8 | GCATGGTGCACCTGACTCCTG | TAACGGCAGACTTCTCCTCAGGAGTCAGGTGCA | 12 | 19 |
| HBB 5.9 | GCATGGTGCACCTGACTCCTG | ACGGCAGACTTCTCCTCAGGAGTCAGGTGCA | 12 | 17 |

TABLE 3P-continued

FIGS. 50A-50B PEgRNA

| PEG RNA | SPACER (SEQ ID NO: 3699-3754) | 3' EXTENSION (5' TO 3')(SEQ ID NO: 3755-3810) | PBS LENGTH (NT) | RT TEMPLATE LENGTH (NT) |
|---|---|---|---|---|
| HBB 5.10 | GCATGGTGCACCT GACTCCTG | GGCAGACTTCTCCTCAGGAGTCA GGTGCA | 12 | 16 |
| HBB 5.11 | GCATGGTGCACCT GACTCCTG | GCAGACTTCTCCTCAGGAGTCAG GTGCA | 12 | 13 |
| HBB 5.12 | GCATGGTGCACCT GACTCCTG | GACTTCTCCTCAGGAGTCAGGTG CA | 12 | 12 |
| HBB 5.13 | GCATGGTGCACCT GACTCCTG | ACTTCTCCTCAGGAGTCAGGTGC A | 12 | 14 |
| HEX AS 1 | ATCCTTCCAGTCA GGGCCAT | ATATCTTATGGCCCTGACTGGAA | 13 | 14 |
| HEX AS 2 | ATCCTTCCAGTCA GGGCCAT | TATATCTTATGGCCCTGACTGGAA | 13 | 15 |
| HEX AS 3 | ATCCTTCCAGTCA GGGCCAT | GTATATCTTATGGCCCTGACTGGA A | 13 | 16 |
| HEX AS 4 | ATCCTTCCAGTCA GGGCCAT | ACCGTATATCTTATGGCCCTGACT GGAA | 13 | 19 |
| HEX AS 5 | ATCCTTCCAGTCA GGGCCAT | AACCGTATATCTTATGGCCCTGAC TGGAA | 13 | 20 |
| HEX AS 6 | ATCCTTCCAGTCA GGGCCAT | GAACCGTATATCTTATGGCCCTGA CTGGAA | 13 | 21 |
| HEX AS 7 | ATCCTTCCAGTCA GGGCCAT | TGAACCGTATATCTTATGGCCCTG ACTGGAA | 13 | 22 |
| HEX AS 8 | ATCCTTCCAGTCA GGGCCAT | ATATCTTATGGCCCTGACT | 9 | 14 |
| HEX AS 9 | ATCCTTCCAGTCA GGGCCAT | TATATCTTATGGCCCTGACT | 9 | 15 |
| HEX AS 10 | ATCCTTCCAGTCA GGGCCAT | GTATATCTTATGGCCCTGACT | 9 | 16 |
| HEX AS 11 | ATCCTTCCAGTCA GGGCCAT | ACCGTATATCTTATGGCCCTGACT | 9 | 19 |
| HEX AS 12 | ATCCTTCCAGTCA GGGCCAT | AACCGTATATCTTATGGCCCTGAC T | 9 | 20 |
| HEX AS 13 | ATCCTTCCAGTCA GGGCCAT | GAACCGTATATCTTATGGCCCTGA CT | 9 | 21 |
| HEX AS 14 | ATCCTTCCAGTCA GGGCCAT | TGAACCGTATATCTTATGGCCCTG ACT | 9 | 22 |
| HEX AS 15 | ATCCTTCCAGTCA GGGCCAT | TGAACCGTATATCTTATGGCCCTG AC | 8 | 22 |
| HEX AS 16 | ATCCTTCCAGTCA GGGCCAT | TGAACCGTATATCTTATGGCCCTG ACTG | 10 | 22 |
| HEX AS 17 | ATCCTTCCAGTCA GGGCCAT | TGAACCGTATATCTTATGGCCCTG ACTGG | 11 | 22 |
| HEX AS 18 | ATCCTTCCAGTCA GGGCCAT | TGAACCGTATATCTTATGGCCCTG ACTGGA | 12 | 22 |
| HEX AS 19 | ATCCTTCCAGTCA GGGCCAT | TGAACCGTATATCTTATGGCCCTG ACTGGAA | 13 | 22 |
| HEX AS 20 | ATCCTTCCAGTCA GGGCCAT | TGAACCGTATATCTTATGGCCCTG ACTGGAAG | 14 | 22 |

TABLE 3P-continued

FIGS. 50A-50B PEgRNA

| PEG RNA | SPACER (SEQ ID NO: 3699-3754) | 3' EXTENSION (5' TO 3')(SEQ ID NO: 3755-3810) | PBS LENGTH (NT) | RT TEMPLATE LENGTH (NT) |
|---|---|---|---|---|
| HEX AS 21 | ATCCTTCCAGTCAGGGCCAT | TGAACCGTATATCTTATGGCCCTGACTGGAAGG | 15 | 22 |
| HEX AS 22 | ATCCTTCCAGTCAGGGCCAT | ACCTGAACCGTATATCTTATGGCCCTGACT | 9 | 25 |
| HEX AS 23 | ATCCTTCCAGTCAGGGCCAT | TACCTGAACCGTATATCTTATGGCCCTGACT | 9 | 26 |
| HEX AS 24 | ATCCTTCCAGTCAGGGCCAT | GTACCTGAACCGTATATCTTATGGCCCTGACT | 9 | 27 |
| HEX AS 25 | ATCCTTCCAGTCAGGGCCAT | GGTACCTGAACCGTATATCTTATGGCCCTGACT | 9 | 28 |
| HEX AS 26 | ATCCTTCCAGTCAGGGCCAT | TGGTACCTGAACCGTATATCTTATGGCCCTGACT | 9 | 29 |
| HEX A 5 | ATCCTTCCAGTCAGGGCCAT | ACCTGAACCGTATATCCTATGGCCCTGACTGGAA | 13 | 21 |
| HEX A6 | ATCCTTCCAGTCAGGGCCAT | ACCGTATATCCTATGGCCCTGACTGGAA | 13 | 15 |
| HEX A 7 | ATCCTTCCAGTCAGGGCCAT | ACCTGAACCGTATATCCTATGGCCCTGACTGGAAGG | 15 | 21 |
| HEX A 8 | ATCCTTCCAGTCAGGGCCAT | ACCTGAACCGTATATCCTATGGCCCTGACTGGAAG | 14 | 21 |
| HEX A 9 | ATCCTTCCAGTCAGGGCCAT | ACCTGAACCGTATATCCTATGGCCCTGACTGGA | 12 | 21 |
| HEX A 10 | ATCCTTCCAGTCAGGGCCAT | ACCTGAACCGTATATCCTATGGCCCTGACTGG | 11 | 21 |
| HEX A 11 | ATCCTTCCAGTCAGGGCCAT | ACCTGAACCGTATATCCTATGGCCCTGACTG | 10 | 21 |
| HEX A 12 | ATCCTTCCAGTCAGGGCCAT | AACCGTATATCCTATGGCCCTGACTGGAA | 13 | 16 |
| HEX A 13 | ATCCTTCCAGTCAGGGCCAT | TGAACCGTATATCCTATGGCCCTGACTGGAA | 13 | 18 |
| HEX A 14 | ATCCTTCCAGTCAGGGCCAT | TACCTGAACCGTATATCCTATGGCCCTGACTGGAA | 13 | 22 |
| HEX A 15 | ATCCTTCCAGTCAGGGCCAT | TGGTACCTGAACCGTATATCCTATGGCCCTGACTGGAA | 13 | 25 |
| HEX A 16 | ATCCTTCCAGTCAGGGCCAT | GTACCTGAACCGTATATCCTATGGCCCTGACTGGAA | 13 | 23 |
| HEX A 17 | ATCCTTCCAGTCAGGGCCAT | AACCGTATATCCTATGGCCCTGACTG | 10 | 16 |
| HEX A 18 | ATCCTTCCAGTCAGGGCCAT | TGAACCGTATATCCTATGGCCCTGACTG | 10 | 18 |
| HEX A 19 | ATCCTTCCAGTCAGGGCCAT | TACCTGAACCGTATATCCTATGGCCCTGACTG | 10 | 22 |
| HEX A 20 | ATCCTTCCAGTCAGGGCCAT | TGGTACCTGAACCGTATATCCTATGGCCCTGACTG | 10 | 25 |

TABLE 3Q

FIGS. 50A-50B nicking sgRNA

| NICKING SGRNA | SPACER SEQUENCE |
|---|---|
| HBB_ED7A_+72 | GCCTTGATACCAACCTGCCCA (SEQ ID NO: 626) |
| HEXA_ED7B_+60 | GCTGGAACTGGTCACCAAGGC (SEQ ID NO: 627) |
| HEXA_ED7B_CORRECT_WT_PE3B | GTACCTGAACCGTATATCCTA (SEQ ID NO: 628) |
| HEXA_ED7B_CORRECT_SILENT_PE3B | GTACCTGAACCGTATATCTTA (SEQ ID NO: 629) |

TABLE 3R

FIGS. 51A-51G PEgRNA

| PEGRNA | SPACER SEQUENCE (SEQ ID NO: 632-640) | 3' EXTENSION (SEQ ID NO: 641-649) | PBS LENGTH (NT) | RT TEMPLATE LENGTH (NT) |
|---|---|---|---|---|
| HEK3_ED8_1 TTOG | GGCCCAGACTGAGCACGTGA | TCTGCCATCCCGTGCTCAGTCTG | 13 | 10 |
| HEK3_ED8_3 ATOC | GGCCCAGACTGAGCACGTGA | TCTGCCAGCACGTGCTCAGTCTG | 13 | 10 |
| HEK3_ED8_3 ATOT | GGCCCAGACTGAGCACGTGA | TCTGCCAACACGTGCTCAGTCTG | 13 | 10 |
| HEK3_ED8_3 ATOT_5-6GGTOTT | GGCCCAGACTGAGCACGTGA | TGGAGGAAGCAGGGCTTCCTTTCCTCTGAAAACACGTGCTCAGTCTG | 13 | 34 |
| HEK3_ED8_1 CTTINS | GGCCCAGACTGAGCACGTGA | TCTGCCATCAAAGCGTGCTCAGTCTG | 13 | 10 |
| RNF2_ED8_1 CTOA | GTCATCTTAGTCATTACCTG | AACGAACACCTCATGTAATGACTAAGATG | 15 | 14 |
| RNF2_ED8_1 CTOG | GTCATCTTAGTCATTACCTG | AACGAACACCTCACGTAATGACTAAGATG | 15 | 14 |
| RNF2_ED8_1 GTAINS | GTCATCTTAGTCATTACCTG | AACGAACACCTCAGTACGTAATGACTAAGATG | 15 | 17 |
| HBB_ED8_4A TOT | GCATGGTGCACCTGACTCCTG | AGACTTCTCCACAGGAGTCAGGTGCAC | 13 | 14 |

TABLE 4

Sequences of primers used for mammalian cell genomic DNA amplification and HTS[181].

| DESCRIPTION | SEQUENCE (SEQ ID NOS: 3811-3863) |
|---|---|
| HEK3 FWD | ACACTCTTTCCCTACACGACGCTCTTCCGATCTNNNNATGTGGGCTGCCTAGAAAGG |
| HEK3 REV | TGGAGTTCAGACGTGTGCTCTTCCGATCTCCCAGCCAAACTTGTCAACC |
| RNF2 FWD | ACACTCTTTCCCTACACGACGCTCTTCCGATCTNNNNACGTCTCATATGCCCCTTGG |
| RNF2 REV | TGGAGTTCAGACGTGTGCTCTTCCGATCTACGTAGGAATTTTGGTGGGACA |
| HEK4 FWD | ACACTCTTTCCCTACACGACGCTCTTCCGATCTNNNNGAACCCAGGTAGCCAGAGAC |
| HEK4 REV | TGGAGTTCAGACGTGTGCTCTTCCGATCTTCCTTTCAACCCGAACGGAG |
| EMX1 FWD | ACACTCTTTCCCTACACGACGCTCTTCCGATCTNNNNCAGCTCAGCCTGAGTGTTGA |

TABLE 4-continued

Sequences of primers used for mammalian cell genomic DNA amplification and HTS[181].

| DESCRIPTION | SEQUENCE (SEQ ID NOS: 3811-3863) |
|---|---|
| EMX1 REV | TGGAGTTCAGACGTGTGCTCTTCCGATCTCTCGTGGGTTTGTGGTTGC |
| FANCF FWD | ACACTCTTTCCCTACACGACGCTCTTCCGATCTNNNNCATTGCAGAGAGGCGTATCA |
| FANCF REV | TGGAGTTCAGACGTGTGCTCTTCCGATCTGGGGTCCCAGGTGCTGAC |
| HBB FWD | ACACTCTTTCCCTACACGACGCTCTTCCGATCTNNNNAGGGTTGGCCAATCTACTCCC |
| HBB REV | TGGAGTTCAGACGTGTGCTCTTCCGATCTGTCTTCTCTGTCTCCACATGCC |
| PRNP FWD | ACACTCTTTCCCTACACGACGCTCTTCCGATCTNNNNGTCAGTGGAACAAGCCGAGT |
| PRNP REV | TGGAGTTCAGACGTGTGCTCTTCCGATCTACTTGGTTGGGGTAACGGTG |
| HEXA FWD | ACACTCTTTCCCTACACGACGCTCTTCCGATCTNNNNCATACAGGTGTGGCGAGAGG |
| HEXA REV | TGGAGTTCAGACGTGTGCTCTTCCGATCTCCAGCCTCCTTTGGTTAGCA |
| RUNX1 FWD | ACACTCTTTCCCTACACGACGCTCTTCCGATCTNNNNTCACAAACAAGACAGGGAACTG |
| RUNX1 REV | TGGAGTTCAGACGTGTGCTCTTCCGATCTAGATGTAGGGCTAGAGGGGTG |
| VEGFA FWD | ACACTCTTTCCCTACACGACGCTCTTCCGATCTNNNNACTTGGTGCCAAATTCTTCTCC |
| VEGFA REV | TGGAGTTCAGACGTGTGCTCTTCCGATCTAAAGAGGGAATGGGCTTTGGA |
| DNMT FWD | ACACTCTTTCCCTACACGACGCTCTTCCGATCTNNNNCACAACAGCTTCATGTCAGCC |
| DNMT REV | TGGAGTTCAGACGTGTGCTCTTCCGATCTACGTTAATGTTTCCTGATGGTCC |
| HEK3 OFF-TARGET SITE 1 FWD | ACACTCTTTCCCTACACGACGCTCTTCCGATCTNNNNTCCCCTGTTGACCTGGAGAA |
| HEK3 OFF-TARGET SITE 1 REV | TGGAGTTCAGACGTGTGCTCTTCCGATCTCACTGTACTTGCCCTGACCA |
| HEK3 OFF-TARGET SITE 2 FWD | ACACTCTTTCCCTACACGACGCTCTTCCGATCTNNNNTTGGTGTTGACAGGGAGCAA |
| HEK3 OFF-TARGET SITE 2 REV | TGGAGTTCAGACGTGTGCTCTTCCGATCTCTGAGATGTGGGCAGAAGGG |
| HEK3 OFF-TARGET SITE 3 FWD | ACACTCTTTCCCTACACGACGCTCTTCCGATCTNNNNTGAGAGGGAACAGAAGGGCT |
| HEK3 OFF-TARGET SITE 3 REV | TGGAGTTCAGACGTGTGCTCTTCCGATCTGTCCAAAGGCCCAAGAACCT |
| HEK3 OFF-TARGET SITE 4 FWD | ACACTCTTTCCCTACACGACGCTCTTCCGATCTNNNNTCCTAGCACTTTGGAAGGTCG |
| HEK3 OFF-TARGET SITE 4 REV | TGGAGTTCAGACGTGTGCTCTTCCGATCTGCTCATCTTAATCTGCTCAGCC |
| HEK4 OFF-TARGET SITE 1 FWD | ACACTCTTTCCCTACACGACGCTCTTCCGATCTNNNNGGCATGGCTTCTGAGACTCA |
| HEK4 OFF-TARGET SITE 1 REV | TGGAGTTCAGACGTGTGCTCTTCCGATCTGTCTCCCTTGCACTCCCTGTCTTT |

TABLE 4-continued

Sequences of primers used for mammalian cell genomic DNA amplification and HTS[181].

| DESCRIPTION | SEQUENCE (SEQ ID NOS: 3811-3863) |
|---|---|
| HEK4 OFF-TARGET SITE 2 FWD | ACACTCTTTCCCTACACGACGCTCTTCCGATCTNNNNTTTGG CAATGGAGGCATTGG |
| HEK4 OFF-TARGET SITE 2 REV | TGGAGTTCAGACGTGTGCTCTTCCGATCTGAAGAGGCTGCC CATGAGAG |
| HEK4 OFF-TARGET SITE 3 FWD | ACACTCTTTCCCTACACGACGCTCTTCCGATCTNNNNGGTCT GAGGCTCGAATCCTG |
| HEK4 OFF-TARGET SITE 3 REV | TGGAGTTCAGACGTGTGCTCTTCCGATCTCTGTGGCCTCCAT ATCCCTG |
| HEK4 OFF-TARGET SITE 4 FWD | ACACTCTTTCCCTACACGACGCTCTTCCGATCTNNNNTTTCC ACCAGAACTCAGCCC |
| HEK4 OFF-TARGET SITE 4 REV | TGGAGTTCAGACGTGTGCTCTTCCGATCTCCTCGGTTCCTCC ACAACAC |
| EMX1 OFF-TARGET SITE 1 FWD | ACACTCTTTCCCTACACGACGCTCTTCCGATCTNNNNGTGGG GAGATTTGCATCTGTGGAGG |
| EMX1 OFF-TARGET SITE 1 REV | TGGAGTTCAGACGTGTGCTCTTCCGATCTGCTTTTATACCATC TTGGGGTTACAG |
| EMX1 OFF-TARGET SITE 2 FWD | ACACTCTTTCCCTACACGACGCTCTTCCGATCTNNNNCAATG TGCTTCAACCCATCACGGC |
| EMX1 OFF-TARGET SITE 2 REV | TGGAGTTCAGACGTGTGCTCTTCCGATCTCCATGAATTTGTG ATGGATGCAGTCTG |
| EMX1 OFF-TARGET SITE 3 FWD | ACACTCTTTCCCTACACGACGCTCTTCCGATCTNNNNGAGAA GGAGGTGCAGGAGCTAGAC |
| EMX1 OFF-TARGET SITE 3 REV | TGGAGTTCAGACGTGTGCTCTTCCGATCTCATCCCGACCTTC ATCCCTCCTGG |
| EMX1 OFF-TARGET SITE 4 FWD | ACACTCTTTCCCTACACGACGCTCTTCCGATCTNNNNGTAGT TCTGACATTCCTCCTGAGGG |
| EMX1 OFF-TARGET SITE 4 REV | TGGAGTTCAGACGTGTGCTCTTCCGATCTTCAAACAAGGTG CAGATACAGCA |
| FANCF OFF-TARGET SITE 1 FWD | ACACTCTTTCCCTACACGACGCTCTTCCGATCTNNNNGCGGG CAGTGGCGTCTTAGTCG |
| FANCF OFF-TARGET SITE 1 REV | TGGAGTTCAGACGTGTGCTCTTCCGATCTCCCTGGGTTTGGT TGGCTGCTC |
| FANCF OFF-TARGET SITE 2 FWD | ACACTCTTTCCCTACACGACGCTCTTCCGATCTNNNNCTCCT TGCCGCCCAGCCGGTC |
| FANCF OFF-TARGET SITE 2 REV | TGGAGTTCAGACGTGTGCTCTTCCGATCTCACTGGGGAAGA GGCGAGGACAC |
| FANCF OFF-TARGET SITE 3 FWD | ACACTCTTTCCCTACACGACGCTCTTCCGATCTNNNNCCAGT GTTTCCCATCCCCAACAC |
| FANCF OFF-TARGET SITE 3 REV | TGGAGTTCAGACGTGTGCTCTTCCGATCTGAATGGATCCCCC CCTAGAGCTC |

TABLE 4-continued

Sequences of primers used for mammalian cell genomic DNA amplification and HTS[181].

| DESCRIPTION | SEQUENCE (SEQ ID NOS: 3811-3863) |
| --- | --- |
| FANCF OFF-TARGET SITE 4 FWD | ACACTCTTTCCCTACACGACGCTCTTCCGATCTNNNNCAGGC CCACAGGTCCTTCTGGA |

TABLE 5

Sequences of 100-mer single-stranded DNA oligonucleotide donor templates used in HDR experiments and in the creation of the HBB E6V HEK293T cell line. Oligonucleotides are 100-103 nt in length with homology arms centered around the site of the edit. Oligonucleotides were from Integrated DNA Technologies, purified by PAGE.

| | |
| --- | --- |
| HEK3 +3 A TO T | GCTTCTCCAGCCCTGGCCTGGGTCAATCCTTGGGGCCCAG ACTGAGCACGTGTTGGCAGAGGAAAGGAAGCCCTGCTTC CTCCAGAGGGCGTCGCAGGAC (SEQ ID NO: 717) |
| HEK3 +3 A TO T, +5,6 GG TO TT | GCTTCTCCAGCCCTGGCCTGGGTCAATCCTTGGGGCCCAG ACTGAGCACGTGTTTTCAGAGGAAAGGAAGCCCTGCTTC CTCCAGAGGGCGTCGCAGGAC (SEQ ID NO: 718) |
| HEK3 +1 T TO G | GCTTCTCCAGCCCTGGCCTGGGTCAATCCTTGGGGCCCAG ACTGAGCACGGGATGGCAGAGGAAAGGAAGCCCTGCTTC CTCCAGAGGGCGTCGCAGGAC (SEQ ID NO: 719) |
| HEK3 +3 A TO C | GCTTCTCCAGCCCTGGCCTGGGTCAATCCTTGGGGCCCAG ACTGAGCACGTGCTGGCAGAGGAAAGGAAGCCCTGCTTC CTCCAGAGGGCGTCGCAGGAC (SEQ ID NO: 720) |
| HEK3 +1 CTT INSERTION | GCTTCTCCAGCCCTGGCCTGGGTCAATCCTTGGGGCCCAG ACTGAGCACGCTTTGATGGCAGAGGAAAGGAAGCCCTGC TTCCTCCAGAGGGCGTCGCAGGAC (SEQ ID NO: 721) |
| RNF2 +1 C TO A | CCCAGTTTACACGTCTCATATGCCCCTTGGCAGTCATCTTA GTCATTACATGAGGTGTTCGTTGTAACTCATATAAACTGAG TTCCCATGTTTTGCTTAA (SEQ ID NO: 722) |
| RNF2 +1 C TO G | CCCAGTTTACACGTCTCATATGCCCCTTGGCAGTCATCTTA GTCATTACGTGAGGTGTTCGTTGTAACTCATATAAACTGAG TTCCCATGTTTTGCTTAA (SEQ ID NO: 723) |
| RNF2 +1 GTA INSERTION | CAGTTTACACGTCTCATATGCCCCTTGGCAGTCATCTTAGT CATTACGTACTGAGGTGTTCGTTGTAACTCATATAAACTGA GTTCCCATGTTTTGCTTA (SEQ ID NO: 724) |
| HBB E6V INSTALLATION (ALSO USED FOR CREATION OF THE HBB E6V HEK293T CELL LINE) | ACTTCATCCACGTTCACCTTGCCCCACAGGGCAGTAACGG CAGACTTCTCCACAGGAGTCAGATGCACCATGGTGTCTGT TTGAGGTTGCTAGTGAACAC (SEQ ID NO: 725) |
| HBB E6V CORRECTION PROTOSPACER A | ACTTCATCCACGTTCACCTTGCCCCACAGGGCAGTAACGG CAGACTTCTCCTCAGGAGTCAGGTGCACCATGGTGTCTGT TTGAGGTTGCTAGTGAACAC (SEQ ID NO: 726) |
| HBB E6V CORRECTION PROTOSPACER B | GTGTTCACTAGCAACCTCAAACAGACACCATGGTGCACCT GACTCCTGAGGAGAAGTCTGCCGTTACTGCCCTGTGGGC AAGGTGAACGTGGATGAAGT (SEQ ID NO: 727) |
| HBB E6V CORRECTION PROTOSPACER B, SILENT PAM MUTATION | GTGTTCACTAGCAACCTCAAACAGACACCATGGTGCACCT GACTCCTGATGAGAAGTCTGCCGTTACTGCCCTGTGGGC AAGGTGAACGTGGATGAAGT (SEQ ID NO: 728) |
| PRNP G127V | CACATGGCTGGTGCTGCAGCAGCTGGGGCAGTGGTGGGG GGCCTTGGCGTCTACATGCTGGGAAGTGCCATGAGCAGGC CCATCATACATTTCGGCAGTG (SEQ ID NO: 729) |

Additional Sequences
Sequences of yeast dual fluorescent reporter plasmids used herein
p425-GFP_stop_mCherry:

(SEQ ID NO: 730)
ATGTCTAAAGGTGAAGAATTATTCACTGGTGTTGTCCCAATTTTGGTTGAATTAGAT

GGTGATGTTAATGGTCACAAATTTTCTGTCTCCGGTGAAGGTGAAGGTGATGCTAC

TTACGGTAAATTGACCTTAAAATTTATTTGTACTACTGGTAAATTGCCAGTTCCATG

GCCAACCTTAGTCACTACTTTCGGTTATGGTGTTCAATGTTTTGCTAGATACCCAGA

TCATATGAAACAACATGACTTTTTCAAGTCTGCCATGCCAGAAGGTTATGTTCAAG

AAAGAACTATTTTTTTCAAAGATGACGGTAACTACAAGACCAGAGCTGAAGTCAA

GTTTGAAGGTGATACCTTAGTTAATAGAATCGAATTAAAAGGTATTGATTTTAAAGA

AGATGGTAACATTTTAGGTCACAAATTGGAATACAACTATAACTCTCACAATGTTTA

CATCATGGCTGACAAACAAAAGAATGGTATCAAAGTTAACTTCAAAATTAGACAC

AACATTGAAGATGGTTCTGTTCAATTAGCTGACCATTATCAACAAAATACTCCAATT

GGTGATGGTCCAGTCTTGTTACCAGACAACCATTACTTATCCACTCAATCTGCCTTA

TCCAAAGATCCAAACGAAAAGAGAGACCACATGGTCTTGTTAGAATTTGTTACTG

CTGCTGGTATTACCCATGGTATGGATGAATTGTACAAAGCTAGCAACCTGGGTCAA

TCCTTGGGGCCCAGACTGAGCACGTGATGGCAGAGCACAGGAGACGTC*ATGGT*

*TTCAAAAGGTGAAGAAGATAATATGGCTATTATTAAAGAATTTATGAGATTTAAAGTTCATA*

*TGGAAGGTTCAGTTAATGGTCATGAATTTGAAATTGAAGGTGAAGGTGAAGGTAGACCA*

*TATGAAGGTACTCAAACTGCTAAATTGAAAGTTACTAAAGGTGGTCCATTACCATTTGCTT*

*GGGATATTTTGTCACCACAATTTATGTATGGTTCAAAAGCTTATGTTAAACATCCAGCTGA*

*TATTCCAGATTATTTAAAATTGTCATTTCCAGAAGGTTTTAAATGGGAAAGAGTTATGAATT*

*TTGAAGATGGTGGTGTTGTTACTGTTACTCAAGATTCATCATTACAAGATGGTGAATTTAT*

*TTATAAAGTTAAATTGAGAGGTACTAATTTTCCATCAGATGGTCCAGTTATGCAAAAAAAA*

*ACTATGGGTTGGGAAGCTTCATCAGAAAGAATGTATCCAGAAGATGGTGCTTTAAAAGG*

*TGAAATTAAACAAAGATTGAAATTAAAAGATGGTGGTCATTATGATGCTGAAGTTAAAACT*

*ACTTATAAAGCTAAAAAACCAGTTCAATTACCAGGTGCTTATAATGTTAATATTAAATTGGA*

*TATTACTTCACATAATGAAGATTATACTATTGTTGAACAATATGAAAGAGCTGAAGGTAGAC*

*ATTCAACTGGTGGTATGGATGAATTATATAAAGGTACCGCTCGAGCAGCTGTGATTGATT*

GAGTCGACTTGGTTGAACACGTTGCCAAGGCTTAAGTGAATTTACTTTAAATCTTG

CATTTAAATAAATTTTCTTTTTATAGCTTTATGACTTAGTTTCAATTTATATACTATTTT

AATGACATTTTCGATTCGGATCCACTAGTTCTAGAGCGGCCGCCACCGCGGTGGAG

CTCCAGCTTTTGTTCCCTTTAGTGAGGGTTAATTGCGCGCTTGGCGTAATCATGGTC

ATAGCTGTTTCCTGTGTGAAATTGTTATCCGCTCACAATTCCACACAACATAGGAG

CCGGAAGCATAAAGTGTAAAGCCTGGGGTGCCTAATGAGTGAGGTAACTCACATT

AATTGCGTTGCGCTCACTGCCCGCTTTCCAGTCGGGAAACCTGTCGTGCCAGCTG

CATTAATGAATCGGCCAACGCGCGGGGAGAGGCGGTTTGCGTATTGGGCGCTCTT

CCGCTTCCTCGCTCACTGACTCGCTGCGCTCGGTCGTTCGGCTGCGGCGAGCGGT

ATCAGCTCACTCAAAGGCGGTAATACGGTTATCCACAGAATCAGGGGATAACGCA

GGAAAGAACATGTGAGCAAAAGGCCAGCAAAAGGCCAGGAACCGTAAAAAGGC

-continued

```
CGCGTTGCTGGCGTTTTTCCATAGGCTCCGCCCCCTGACGAGCATCACAAAAATC

GACGCTCAAGTCAGAGGTGGCGAAACCCGACAGGACTATAAAGATACCAGGCGT

TTCCCCCTGGAAGCTCCCTCGTGCGCTCTCCTGTTCCGACCCTGCCGCTTACCGGA

TACCTGTCCGCCTTTCTCCCTTCGGGAAGCGTGGCGCTTTCTCATAGCTCACGCTG

TAGGTATCTCAGTTCGGTGTAGGTCGTTCGCTCCAAGCTGGGCTGTGTGCACGAAC

CCCCCGTTCAGCCCGACCGCTGCGCCTTATCCGGTAACTATCGTCTTGAGTCCAAC

CCGGTAAGACACGACTTATCGCCACTGGCAGCAGCCACTGGTAACAGGATTAGCA

GAGCGAGGTATGTAGGCGGTGCTACAGAGTTCTTGAAGTGGTGGCCTAACTACGG

CTACACTAGAAGGACAGTATTTGGTATCTGCGCTCTGCTGAAGCCAGTTACCTTCG

GAAAAAGAGTTGGTAGCTCTTGATCCGGCAAACAAACCACCGCTGGTAGCGGTG

GTTTTTTTGTTTGCAAGCAGCAGATTACGCGCAGAAAAAAAGGATCTCAAGAAGA

TCCTTTGATCTTTTCTACGGGGTCTGACGCTCAGTGGAACGAAAACTCACGTTAAG

GGATTTTGGTCATGAGATTATCAAAAAGGATCTTCACCTAGATCCTTTTAAATTAAA

AATGAAGTTTTAAATCAATCTAAAGTATATATGAGTAAACTTGGTCTGACAGTTACC

AATGCTTAATCAGTGAGGCACCTATCTCAGCGATCTGTCTATTTCGTTCATCCATAG

TTGCCTGACTCCCCGTCGTGTAGATAACTACGATACGGGAGGGCTTACCATCTGGC

CCCAGTGCTGCAATGATACCGCGAGACCCACGCTCACCGGCTCCAGATTTATCAGC

AATAAACCAGCCAGCCGGAAGGGCCGAGCGCAGAAGTGGTCCTGCAACTTTATCC

GCCTCCATCCAGTCTATTAATTGTTGCCGGGAAGCTAGAGTAAGTAGTTCGCCAGT

TAATAGTTTGCGCAACGTTGTTGCCATTGCTACAGGCATCGTGGTGTCACGCTCGT

CGTTTGGTATGGCTTCATTCAGCTCCGGTTCCCAACGATCAAGGCGAGTTACATGA

TCCCCCATGTTGTGCAAAAAAGCGGTTAGCTCCTTCGGTCCTCCGATCGTTGTCAG

AAGTAAGTTGGCCGCAGTGTTATCACTCATGGTTATGGCAGCACTGCATAATTCTC

TTACTGTCATGCCATCCGTAAGATGCTTTTCTGTGACTGGTGAGTACTCAACCAAG

TCATTCTGAGAATAGTGTATGCGGCGACCGAGTTGCTCTTGCCCGGCGTCAATACG

GGATAATACCGCGCCACATAGCAGAACTTTAAAAGTGCTCATCATTGGAAAACGTT

CTTCGGGGCGAAAACTCTCAAGGATCTTACCGCTGTTGAGATCCAGTTCGATGTAA

CCCACTCGTGCACCCAACTGATCTTCAGCATCTTTTACTTTCACCAGCGTTTCTGG

GTGAGCAAAAACAGGAAGGCAAAATGCCGCAAAAAAGGGAATAAGGGCGACAC

GGAAATGTTGAATACTCATACTCTTCCTTTTTCAATATTATTGAAGCATTTATCAGGG

TTATTGTCTCATGAGCGGATACATATTTGAATGTATTTAGAAAAATAAACAAATAGG

GGTTCCGCGCACATTTCCCCGAAAAGTGCCACCTGAACGAAGCATCTGTGCTTCA

TTTTGTAGAACAAAAATGCAACGCGAGAGCGCTAATTTTTCAAACAAAGAATCTG

AGCTGCATTTTTACAGAACAGAAATGCAACGCGAAAGCGCTATTTTACCAACGAA

GAATCTGTGCTTCATTTTTGTAAAACAAAAATGCAACGCGAGAGCGCTAATTTTTC

AAACAAAGAATCTGAGCTGCATTTTTACAGAACAGAAATGCAACGCGAGAGCGCT

ATTTTACCAACAAAGAATCTATACTTCTTTTTTGTTCTACAAAAATGCATCCCGAGA

GCGCTATTTTTCTAACAAAGCATCTTAGATTACTTTTTTTCTCCTTTGTGCGCTCTAT

AATGCAGTCTCTTGATAACTTTTTGCACTGTAGGTCCGTTAAGGTTAGAAGAAGGC

TACTTTGGTGTCTATTTTCTCTTCCATAAAAAAAGCCTGACTCCACTTCCCGCGTTT

ACTGATTACTAGCGAAGCTGCGGGTGCATTTTTTCAAGATAAAGGCATCCCCGATT
```

-continued

```
ATATTCTATACCGATGTGGATTGCGCATACTTTGTGAACAGAAAGTGATAGCGTTGA

TGATTCTTCATTGGTCAGAAAATTATGAACGGTTTCTTCTATTTTGTCTCTATATACT

ACGTATAGGAAATGTTTACATTTTCGTATTGTTTTCGATTCACTCTATGAATAGTTCT

TACTACAATTTTTTTGTCTAAAGAGTAATACTAGAGATAAACATAAAAAATGTAGAG

GTCGAGTTTAGATGCAAGTTCAAGGAGCGAAAGGTGGATGGGTAGGTTATATAGG

GATATAGCACAGAGATATATAGCAAAGAGATACTTTTGAGCAATGTTTGTGGAAGC

GGTATTCGCAATATTTTAGTAGCTCGTTACAGTCCGGTGCGTTTTTGGTTTTTTGAA

AGTGCGTCTTCAGAGCGCTTTTGGTTTTCAAAAGCGCTCTGAAGTTCCTATACTTT

CTAGAGAATAGGAACTTCGGAATAGGAACTTCAAAGCGTTTCCGAAAACGAGCGC

TTCCGAAAATGCAACGCGAGCTGCGCACATACAGCTCACTGTTCACGTCGCACCT

ATATCTGCGTGTTGCCTGTATATATATATACATGAGAAGAACGGCATAGTGCGTGTTT

ATGCTTAAATGCGTACTTATATGCGTCTATTTATGTAGGATGAAAGGTAGTCTAGTAC

CTCCTGTGATATTATCCCATTCCATGCGGGGTATCGTATGCTTCCTTCAGCACTACCC

TTTAGCTGTTCTATATGCTGCCACTCCTCAATTGGATTAGTCTCATCCTTCAATGCTA

TCATTTCCTTTGATATTGGATCATACTAAGAAACCATTATTATCATGACATTAACCTA

TAAAAATAGGCGTATCACGAGGCCCTTTCGTCTCGCGCGTTTCGGTGATGACGGTG

AAAACCTCTGACACATGCAGCTCCCGGAGACGGTCACAGCTTGTCTGTAAGCGGA

TGCCGGGAGCAGACAAGCCCGTCAGGGCGCGTCAGCGGGTGTTGGCGGGTGTCG

GGGCTGGCTTAACTATGCGGCATCAGAGCAGATTGTACTGAGAGTGCACCATATCG

ACTACGTCGTAAGGCCGTTTCTGACAGAGTAAAATTCTTGAGGGAACTTTCACCAT

TATGGGAAATGCTTCAAGAAGGTATTGACTTAAACTCCATCAAATGGTCAGGTCAT

TGAGTGTTTTTTATTTGTTGTATTTTTTTTTTTTAGAGAAAATCCTCCAATATCAAA

TTAGGAATCGTAGTTTCATGATTTTCTGTTACACCTAACTTTTTGTGTGGTGCCCTC

CTCCTTGTCAATATTAATGTTAAAGTGCAATTCTTTTTCCTTATCACGTTGAGCCATT

AGTATCAATTTGCTTACCTGTATTCCTTTACTATCCTCCTTTTTCTCCTTCTTGATAA

ATGTATGTAGATTGCGTATATAGTTTCGTCTACCCTATGAACATATTCCATTTTGTAAT

TTCGTGTCGTTTCTATTATGAATTTCATTTATAAAGTTTATGTACAAATATCATAAAA

AAAGAGAATCTTTTTAAGCAAGGATTTTCTTAACTTCTTCGGCGACAGCATCACCG

ACTTCGGTGGTACTGTTGGAACCACCTAAATCACCAGTTCTGATACCTGCATCCAA

AACCTTTTTAACTGCATCTTCAATGGCCTTACCTTCTTCAGGCAAGTTCAATGACA

ATTTCAACATCATTGCAGCAGACAAGATAGTGGCGATAGGGTCAACCTTATTCTTT

GGCAAATCTGGAGCAGAACCGTGGCATGGTTCGTACAAACCAAATGCGGTGTTCT

TGTCTGGCAAAGAGGCCAAGGACGCAGATGGCAACAAACCCAAGGAACCTGGGA

TAACGGAGGCTTCATCGGAGATGATATCACCAAACATGTTGCTGGTGATTATAATAC

CATTTAGGTGGGTTGGGTTCTTAACTAGGATCATGGCGGCAGAATCAATCAATTGA

TGTTGAACCTTCAATGTAGGGAATTCGTTCTTGATGGTTTCCTCCACAGTTTTTCTC

CATAATCTTGAAGAGGCCAAAAGATTAGCTTTATCCAAGGACCAAATAGGCAATGG

TGGCTCATGTTGTAGGGCCATGAAAGCGGCCATTCTTGTGATTCTTTGCACTTCTG

GAACGGTGTATTGTTCACTATCCCAAGCGACACCATCACCATCGTCTTCCTTTCTCT

TACCAAAGTAAATACCTCCCACTAATTCTCTGACAACAACGAAGTCAGTACCTTTA
```

-continued

```
GCAAATTGTGGCTTGATTGGAGATAAGTCTAAAAGAGAGTCGGATGCAAAGTTAC
ATGGTCTTAAGTTGGCGTACAATTGAAGTTCTTTACGGATTTTTAGTAAACCTTGTT
CAGGTCTAACACTACCGGTACCCCATTTAGGACCAGCCACAGCACCTAACAAAAC
GGCATCAACCTTCTTGGAGGCTTCCAGCGCCTCATCTGGAAGTGGGACACCTGTA
GCATCGATAGCAGCACCACCAATTAAATGATTTTCGAAATCGAACTTGACATTGGA
ACGAACATCAGAAATAGCTTTAAGAACCTTAATGGCTTCGGCTGTGATTTCTTGAC
CAACGTGGTCACCTGGCAAAACGACGATCTTCTTAGGGGCAGACATAGGGGCAG
ACATTAGAATGGTATATCCTTGAAATATATATATATATTGCTGAAATGTAAAAGGTAA
GAAAAGTTAGAAAGTAAGACGATTGCTAACCACCTATTGGAAAAAACAATAGGTC
CTTAAATAATATTGTCAACTTCAAGTATTGTGATGCAAGCATTTAGTCATGAACGCT
TCTCTATTCTATATGAAAAGCCGGTTCCGGCCTCTCACCTTTCCTTTTTCTCCCAATT
TTTCAGTTGAAAAAGGTATATGCGTCAGGCGACCTCTGAAATTAACAAAAAATTTC
CAGTCATCGAATTTGATTCTGTGCGATAGCGCCCCTGTGTGTTCTCGTTATGTTGAG
GAAAAAAATAATGGTTGCTAAGAGATTCGAACTCTTGCATCTTACGATACCTGAGT
ATTCCCACAGTTAACTGCGGTCAAGATATTCTTGAATCAGGCGCCTTAGACCGCT
CGGCCAAACAACCAATTACTTGTTGAGAAATAGAGTATAATTATCCTATAAATATAA
CGTTTTTGAACACACATGAACAAGGAAGTACAGGACAATTGATTTTGAAGAGAAT
GTGGATTTTGATGTAATTGTTGGGATTCCATTTTTAATAAGGCAATAATATTAGGTAT
GTGGATATACTAGAAGTTCTCCTCGACCGTCGATATGCGGTGTGAAATACCGCACA
GATGCGTAAGGAGAAAATACCGCATCAGGAAATTGTAAACGTTAATATTTTGTTAA
AATTCGCGTTAAATTTTTGTTAAATCAGCTCATTTTTTAACCAATAGGCCGAAATCG
GCAAATCCCTTATAAATCAAAAGAATAGACCGAGATAGGGTTGAGTGTTGTTCCA
GTTTGGAACAAGAGTCCACTATTAAAGAACGTGGACTCCAACGTCAAAGGGCGA
AAAACCGTCTATCAGGGCGATGGCCCACTACGTGAACCATCACCCTAATCAAGTTT
TTTGGGGTCGAGGTGCCGTAAAGCACTAAATCGGAACCCTAAAGGGAGCCCCCGA
TTTAGAGCTTGACGGGGAAAGCCGGCGAACGTGGCGAGAAAGGAAGGGAAGAA
AGCGAAAGGAGCGGGCGCTAGGGCGCTGGCAAGTGTAGCGGTCACGCTGCGCGT
AACCACCACACCCGCCGCGCTTAATGCGCCGCTACAGGGCGCGTCGCGCCATTCG
CCATTCAGGCTGCGCAACTGTTGGGAAGGGCGATCGGTGCGGGCCTCTTCGCTAT
TACGCCAGCTGGCGAAAGGGGGATGTGCTGCAAGGCGATTAAGTTGGGTAACGCC
AGGGTTTTCCCAGTCACGACGTTGTAAAACGACGGCCAGTGAGCGCGCGTAATAC
GACTCACTATAGGGCGAATTGGGTACCGGGCCCCCCCTCGAGGTCGACGGTATCG
ATAAGCTTGATATCGAATTCCTGCAGCCCGGGGGATCCGTTAGAATCATTTTGAATA
AAAAACACGCTTTTTCAGTTCGAGTTTATCATTATCAATACTGCCATTTCAAAGAAT
ACGTAAATAATTAATAGTAGTGATTTTCCTAACTTTATTTAGTCAAAAAATTAGCCTT
TTAATTCTGCTGTAACCCGTACATGCCCAAAATAGGGGGCGGGTTACACAGAATAT
ATAACATCGTAGGTGTCTGGGTGAACAGTTTATTCCTGGCATCCACTAAATATAATG
GAGCCCGCTTTTTAAGCTGGCATCCAGAAAAAAAAAGAATCCCAGCACCAAAATA
TTGTTTTCTTCACCAACCATCAGTTCATAGGTCCATTCTCTTAGCGCAACTACAGAG
AACAGGGGCACAAACAGGCAAAAAACGGGCACAACCTCAATGGAGTGATGCAA
CCTGCCTGGAGTAAATGATGACACAAGGCAATTGACCCACGCATGTATCTATCTCA
```

-continued

TTTTCTTACACCTTCTATTACCTTCTGCTCTCTCTGATTTGGAAAAAGCTGAAAAAA

AAGGTTGAAACCAGTTCCCTGAAATTATTCCCCTACTTGACTAATAAGTATATAAAG

ACGGTAGGTATTGATTGTAATTCTGTAAATCTATTTCTTAAACTTCTTAAATTCTACT

TTTATAGTTAGTCTTTTTTTTAGTTTTAAAACACCAAGAACTTAGTTTCGAATAAAC

ACACATAAACAAACAAAGAATTC p425-GFP_+1fs_mCherry:

(SEQ ID NO: 731)

ATGTCTAAAGGTGAAGAATTATTCACTGGTGTTGTCCCAATTTTGGTTGAATTAGAT

GGTGATGTTAATGGTCACAAATTTTCTGTCTCCGGTGAAGGTGAAGGTGATGCTAC

TTACGGTAAATTGACCTTAAAATTTATTTGTACTACTGGTAAATTGCCAGTTCCATG

GCCAACCTTAGTCACTACTTTCGGTTATGGTGTTCAATGTTTTGCTAGATACCCAGA

TCATATGAAACAACATGACTTTTTCAAGTCTGCCATGCCAGAAGGTTATGTTCAAG

AAAGAACTATTTTTTTCAAAGATGACGGTAACTACAAGACCAGAGCTGAAGTCAA

GTTTGAAGGTGATACCTTAGTTAATAGAATCGAATTAAAAGGTATTGATTTTAAAGA

AGATGGTAACATTTTAGGTCACAAATTGGAATACAACTATAACTCTCACAATGTTTA

CATCATGGCTGACAAACAAAAGAATGGTATCAAAGTTAACTTCAAAATTAGACAC

AACATTGAAGATGGTTCTGTTCAATTAGCTGACCATTATCAACAAAATACTCCAATT

GGTGATGGTCCAGTCTTGTTACCAGACAACCATTACTTATCCACTCAATCTGCCTTA

TCCAAAGATCCAAACGAAAAGAGAGACCACATGGTCTTGTTAGAATTTGTTACTG

CTGCTGGTATTACCCATGGTATGGATGAATTGTACAAAGCTAGCAAACCTGGGTCA

ATCCTTGGGGCCCAGACTGAGCACGTGATGGCAGAGCACAGGAGACGTCATGG

*TTTCAAAAGGTGAAGAAGATAATATGGCTATTATTAAAGAATTTGAGATTTAAAGTTCAT*

*ATGGAAGGTTCAGTTAATGGTCATGAATTTGAAATTGAAGGTGAAGGTGAAGGTAGACC*

*ATATGAAGGTACTCAAACTGCTAAATTGAAAGTTACTAAAGGTGGTCCATTACCATTTGCT*

*TGGGATATTTTGTCACCACAATTTATGTATGGTTCAAAAGCTTATGTTAAACATCCAGCTG*

*ATATTCCAGATTATTTAAAATTGTCATTTCCAGAAGGTTTTAAATGGGAAAGAGTTATGAAT*

*TTTGAAGATGGTGGTGTTGTTACTGTTACTCAAGATTCATCATTACAAGATGGTGAATTTA*

*TTTATAAAGTTAAATTGAGAGGTACTAATTTTCCATCAGATGGTCCAGTTATGCAAAAAAA*

*AACTATGGGTTGGGAAGCTTCATCAGAAAGAATGTATCCAGAAGATGGTGCTTTAAAAG*

*GTGAAATTAAACAAAGATTGAAATTAAAAGATGGTGGTCATTATGATGCTGAAGTTAAAAC*

*TACTTATAAAGCTAAAAAACCAGTTCAATTACCAGGTGCTTATAATGTTAATATTAAATTGG*

*ATATTACTTCACATAATGAAGATTATACTATTGTTGAACAATATGAAAGAGCTGAAGGTAGA*

*CATTCAACTGGTGGTATGGATGAATTATATAAAGGTACCGCTCGAGCAGCTGTGATTGAT*

TGAGTCGACTTGGTTGAACACGTTGCCAAGGCTTAAGTGAATTTACTTTAAATCTT

GCATTTAAATAAATTTTCTTTTTATAGCTTTATGACTTAGTTTCAATTTATATACTATT

TTAATGACATTTTCGATTCGGATCCACTAGTTCTAGAGCGGCCGCCACCGCGGTGG

AGCTCCAGCTTTTGTTCCCTTTAGTGAGGGTTAATTGCGCGCTTGGCGTAATCATG

GTCATAGCTGTTTCCTGTGTGAAATTGTTATCCGCTCACAATTCCACACAACATAGG

AGCCGGAAGCATAAAGTGTAAAGCCTGGGGTGCCTAATGAGTGAGGTAACTCACA

TTAATTGCGTTGCGCTCACTGCCCGCTTTCCAGTCGGGAAACCTGTCGTGCCAGCT

-continued

```
GCATTAATGAATCGGCCAACGCGCGGGGAGAGGCGGTTTGCGTATTGGGCGCTCT

TCCGCTTCCTCGCTCACTGACTCGCTGCGCTCGGTCGTTCGGCTGCGGCGAGCGG

TATCAGCTCACTCAAAGGCGGTAATACGGTTATCCACAGAATCAGGGGATAACGCA

GGAAAGAACATGTGAGCAAAAGGCCAGCAAAAGGCCAGGAACCGTAAAAAGGC

CGCGTTGCTGGCGTTTTTCCATAGGCTCCGCCCCCCTGACGAGCATCACAAAAATC

GACGCTCAAGTCAGAGGTGGCGAAACCCGACAGGACTATAAAGATACCAGGCGT

TTCCCCCTGGAAGCTCCCTCGTGCGCTCTCCTGTTCCGACCCTGCCGCTTACCGGA

TACCTGTCCGCCTTTCTCCCTTCGGGAAGCGTGGCGCTTTCTCATAGCTCACGCTG

TAGGTATCTCAGTTCGGTGTAGGTCGTTCGCTCCAAGCTGGGCTGTGTGCACGAAC

CCCCCGTTCAGCCCGACCGCTGCGCCTTATCCGGTAACTATCGTCTTGAGTCCAAC

CCGGTAAGACACGACTTATCGCCACTGGCAGCAGCCACTGGTAACAGGATTAGCA

GAGCGAGGTATGTAGGCGGTGCTACAGAGTTCTTGAAGTGGTGGCCTAACTACGG

CTACACTAGAAGGACAGTATTTGGTATCTGCGCTCTGCTGAAGCCAGTTACCTTCG

GAAAAAGAGTTGGTAGCTCTTGATCCGGCAAACAAACCACCGCTGGTAGCGGTG

GTTTTTTTGTTTGCAAGCAGCAGATTACGCGCAGAAAAAAAGGATCTCAAGAAGA

TCCTTTGATCTTTTCTACGGGGTCTGACGCTCAGTGGAACGAAAACTCACGTTAAG

GGATTTTGGTCATGAGATTATCAAAAAGGATCTTCACCTAGATCCTTTTAAATTAAA

AATGAAGTTTTAAATCAATCTAAAGTATATATGAGTAAACTTGGTCTGACAGTTACC

AATGCTTAATCAGTGAGGCACCTATCTCAGCGATCTGTCTATTTCGTTCATCCATAG

TTGCCTGACTCCCCGTCGTGTAGATAACTACGATACGGGAGGGCTTACCATCTGGC

CCCAGTGCTGCAATGATACCGCGAGACCCACGCTCACCGGCTCCAGATTTATCAGC

AATAAACCAGCCAGCCGGAAGGGCCGAGCGCAGAAGTGGTCCTGCAACTTTATCC

GCCTCCATCCAGTCTATTAATTGTTGCCGGGAAGCTAGAGTAAGTAGTTCGCCAGT

TAATAGTTTGCGCAACGTTGTTGCCATTGCTACAGGCATCGTGGTGTCACGCTCGT

CGTTTGGTATGGCTTCATTCAGCTCCGGTTCCCAACGATCAAGGCGAGTTACATGA

TCCCCCATGTTGTGCAAAAAAGCGGTTAGCTCCTTCGGTCCTCCGATCGTTGTCAG

AAGTAAGTTGGCCGCAGTGTTATCACTCATGGTTATGGCAGCACTGCATAATTCTC

TTACTGTCATGCCATCCGTAAGATGCTTTTCTGTGACTGGTGAGTACTCAACCAAG

TCATTCTGAGAATAGTGTATGCGGCGACCGAGTTGCTCTTGCCCGGCGTCAATACG

GGATAATACCGCGCCACATAGCAGAACTTTAAAAGTGCTCATCATTGGAAAACGTT

CTTCGGGGCGAAAACTCTCAAGGATCTTACCGCTGTTGAGATCCAGTTCGATGTAA

CCCACTCGTGCACCCAACTGATCTTCAGCATCTTTTACTTTCACCAGCGTTTCTGG

GTGAGCAAAAACAGGAAGGCAAAATGCCGCAAAAAAGGGAATAAGGGCGACAC

GGAAATGTTGAATACTCATACTCTTCCTTTTTCAATATTATTGAAGCATTTATCAGGG

TTATTGTCTCATGAGCGGATACATATTTGAATGTATTTAGAAAAATAAACAAATAGG

GGTTCCGCGCACATTTCCCCGAAAAGTGCCACCTGAACGAAGCATCTGTGCTTCA

TTTTGTAGAACAAAAATGCAACGCGAGAGCGCTAATTTTTCAAACAAAGAATCTG

AGCTGCATTTTTACAGAACAGAAATGCAACGCGAAAGCGCTATTTTACCAACGAA

GAATCTGTGCTTCATTTTTGTAAAACAAAAATGCAACGCGAGAGCGCTAATTTTTC

AAACAAAGAATCTGAGCTGCATTTTTACAGAACAGAAATGCAACGCGAGAGCGCT
```

-continued

```
ATTTTACCAACAAAGAATCTATACTTCTTTTTGTTCTACAAAAATGCATCCCGAGA

GCGCTATTTTTCTAACAAAGCATCTTAGATTACTTTTTTTCTCCTTTGTGCGCTCTAT

AATGCAGTCTCTTGATAACTTTTTGCACTGTAGGTCCGTTAAGGTTAGAAGAAGGC

TACTTTGGTGTCTATTTTCTCTTCCATAAAAAAAGCCTGACTCCACTTCCCGCGTTT

ACTGATTACTAGCGAAGCTGCGGGTGCATTTTTTCAAGATAAAGGCATCCCCGATT

ATATTCTATACCGATGTGGATTGCGCATACTTTGTGAACAGAAAGTGATAGCGTTGA

TGATTCTTCATTGGTCAGAAAATTATGAACGGTTTCTTCTATTTTGTCTCTATATACT

ACGTATAGGAAATGTTTACATTTTCGTATTGTTTTCGATTCACTCTATGAATAGTTCT

TACTACAATTTTTTTGTCTAAAGAGTAATACTAGAGATAAACATAAAAAATGTAGAG

GTCGAGTTTAGATGCAAGTTCAAGGAGCGAAAGGTGGATGGGTAGGTTATATAGG

GATATAGCACAGAGATATATAGCAAAGAGATACTTTTGAGCAATGTTTGTGGAAGC

GGTATTCGCAATATTTTAGTAGCTCGTTACAGTCCGGTGCGTTTTTGGTTTTTTGAA

AGTGCGTCTTCAGAGCGCTTTTGGTTTTCAAAAGCGCTCTGAAGTTCCTATACTTT

CTAGAGAATAGGAACTTCGGAATAGGAACTTCAAAGCGTTTCCGAAAACGAGCGC

TTCCGAAAATGCAACGCGAGCTGCGCACATACAGCTCACTGTTCACGTCGCACCT

ATATCTGCGTGTTGCCTGTATATATATATACATGAGAAGAACGGCATAGTGCGTGTTT

ATGCTTAAATGCGTACTTATATGCGTCTATTTATGTAGGATGAAAGGTAGTCTAGTAC

CTCCTGTGATATTATCCCATTCCATGCGGGGTATCGTATGCTTCCTTCAGCACTACCC

TTTAGCTGTTCTATATGCTGCCACTCCTCAATTGGATTAGTCTCATCCTTCAATGCTA

TCATTTCCTTTGATATTGGATCATACTAAGAAACCATTATTATCATGACATTAACCTA

TAAAAATAGGCGTATCACGAGGCCCTTTCGTCTCGCGCGTTTCGGTGATGACGGTG

AAAACCTCTGACACATGCAGCTCCCGGAGACGGTCACAGCTTGTCTGTAAGCGGA

TGCCGGGAGCAGACAAGCCCGTCAGGGCGCGTCAGCGGGTGTTGGCGGGTGTCG

GGGCTGGCTTAACTATGCGGCATCAGAGCAGATTGTACTGAGAGTGCACCATATCG

ACTACGTCGTAAGGCCGTTTCTGACAGAGTAAAATTCTTGAGGGAACTTTCACCAT

TATGGGAAATGCTTCAAGAAGGTATTGACTTAAACTCCATCAAATGGTCAGGTCAT

TGAGTGTTTTTTATTTGTTGTATTTTTTTTTTTAGAGAAAATCCTCCAATATCAAA

TTAGGAATCGTAGTTTCATGATTTTCTGTTACACCTAACTTTTTGTGTGGTGCCCTC

CTCCTTGTCAATATTAATGTTAAAGTGCAATTCTTTTTCCTTATCACGTTGAGCCATT

AGTATCAATTTGCTTACCTGTATTCCTTTACTATCCTCCTTTTTCTCCTTCTTGATAA

ATGTATGTAGATTGCGTATATAGTTTCGTCTACCCTATGAACATATTCCATTTTGTAAT

TTCGTGTCGTTTCTATTATGAATTTCATTTATAAAGTTTATGTACAAATATCATAAAA

AAAGAGAATCTTTTTAAGCAAGGATTTTCTTAACTTCTTCGGCGACAGCATCACCG

ACTTCGGTGGTACTGTTGGAACCACCTAAATCACCAGTTCTGATACCTGCATCCAA

AACCTTTTTAACTGCATCTTCAATGGCCTTACCTTCTTCAGGCAAGTTCAATGACA

ATTTCAACATCATTGCAGCAGACAAGATAGTGGCGATAGGGTCAACCTTATTCTTT

GGCAAATCTGGAGCAGAACCGTGGCATGGTTCGTACAAACCAAATGCGGTGTTCT

TGTCTGGCAAAGAGGCCAAGGACGCAGATGGCAACAAACCCAAGGAACCTGGGA

TAACGGAGGCTTCATCGGAGATGATATCACCAAACATGTTGCTGGTGATTATAATAC

CATTTAGGTGGGTTGGGTTCTTAACTAGGATCATGGCGGCAGAATCAATCAATTGA

TGTTGAACCTTCAATGTAGGGAATTCGTTCTTGATGGTTTCCTCCACAGTTTTTCTC
```

-continued

```
CATAATCTTGAAGAGGCCAAAAGATTAGCTTTATCCAAGGACCAAATAGGCAATGG

TGGCTCATGTTGTAGGGCCATGAAAGCGGCCATTCTTGTGATTCTTTGCACTTCTG

GAACGGTGTATTGTTCACTATCCCAAGCGACACCATCACCATCGTCTTCCTTTCTCT

TACCAAAGTAAATACCTCCCACTAATTCTCTGACAACAACGAAGTCAGTACCTTTA

GCAAATTGTGGCTTGATTGGAGATAAGTCTAAAAGAGAGTCGGATGCAAAGTTAC

ATGGTCTTAAGTTGGCGTACAATTGAAGTTCTTTACGGATTTTTAGTAAACCTTGTT

CAGGTCTAACACTACCGGTACCCCATTTAGGACCAGCCACAGCACCTAACAAAAC

GGCATCAACCTTCTTGGAGGCTTCCAGCGCCTCATCTGGAAGTGGGACACCTGTA

GCATCGATAGCAGCACCACCAATTAAATGATTTTCGAAATCGAACTTGACATTGGA

ACGAACATCAGAAATAGCTTTAAGAACCTTAATGGCTTCGGCTGTGATTTCTTGAC

CAACGTGGTCACCTGGCAAAACGACGATCTTCTTAGGGGCAGACATAGGGGCAG

ACATTAGAATGGTATATCCTTGAAATATATATATATATTGCTGAAATGTAAAAGGTAA

GAAAAGTTAGAAAGTAAGACGATTGCTAACCACCTATTGGAAAAAACAATAGGTC

CTTAAATAATATTGTCAACTTCAAGTATTGTGATGCAAGCATTTAGTCATGAACGCT

TCTCTATTCTATATGAAAAGCCGGTTCCGGCCTCTCACCTTTCCTTTTTCTCCCAATT

TTTCAGTTGAAAAAGGTATATGCGTCAGGCGACCTCTGAAATTAACAAAAAATTTC

CAGTCATCGAATTTGATTCTGTGCGATAGCGCCCCTGTGTGTTCTCGTTATGTTGAG

GAAAAAAATAATGGTTGCTAAGAGATTCGAACTCTTGCATCTTACGATACCTGAGT

ATTCCCACAGTTAACTGCGGTCAAGATATTTCTTGAATCAGGCGCCTTAGACCGCT

CGGCCAAACAACCAATTACTTGTTGAGAAATAGAGTATAATTATCCTATAAATATAA

CGTTTTTGAACACACATGAACAAGGAAGTACAGGACAATTGATTTTGAAGAGAAT

GTGGATTTTGATGTAATTGTTGGGATTCCATTTTTAATAAGGCAATAATATTAGGTAT

GTGGATATACTAGAAGTTCTCCTCGACCGTCGATATGCGGTGTGAAATACCGCACA

GATGCGTAAGGAGAAAATACCGCATCAGGAAATTGTAAACGTTAATATTTTGTTAA

AATTCGCGTTAAATTTTTGTTAAATCAGCTCATTTTTTAACCAATAGGCCGAAATCG

GCAAAATCCCTTATAAATCAAAAGAATAGACCGAGATAGGGTTGAGTGTTGTTCCA

GTTTGGAACAAGAGTCCACTATTAAAGAACGTGGACTCCAACGTCAAAGGGCGA

AAAACCGTCTATCAGGGCGATGGCCCACTACGTGAACCATCACCCTAATCAAGTTT

TTTGGGGTCGAGGTGCCGTAAAGCACTAAATCGGAACCCTAAAGGGAGCCCCCGA

TTTAGAGCTTGACGGGGAAAGCCGGCGAACGTGGCGAGAAAGGAAGGGAAGAA

AGCGAAAGGAGCGGGCGCTAGGGCGCTGGCAAGTGTAGCGGTCACGCTGCGCGT

AACCACCACACCCGCCGCGCTTAATGCGCCGCTACAGGGCGCGTCGCGCCATTCG

CCATTCAGGCTGCGCAACTGTTGGGAAGGGCGATCGGTGCGGGCCTCTTCGCTAT

TACGCCAGCTGGCGAAAGGGGGATGTGCTGCAAGGCGATTAAGTTGGGTAACGCC

AGGGTTTTCCCAGTCACGACGTTGTAAAACGACGGCCAGTGAGCGCGCGTAATAC

GACTCACTATAGGGCGAATTGGGTACCGGGCCCCCCCTCGAGGTCGACGGTATCG

ATAAGCTTGATATCGAATTCCTGCAGCCCGGGGGATCCGTTAGAATCATTTTGAATA

AAAAACACGCTTTTTCAGTTCGAGTTTATCATTATCAATACTGCCATTTCAAAGAAT

ACGTAAATAATTAATAGTAGTGATTTTCCTAACTTTATTTAGTCAAAAAATTAGCCTT

TTAATTCTGCTGTAACCCGTACATGCCCAAAATAGGGGGCGGGTTACACAGAATAT
```

-continued

ATAACATCGTAGGTGTCTGGGTGAACAGTTTATTCCTGGCATCCACTAAATATAATG

GAGCCCGCTTTTTAAGCTGGCATCCAGAAAAAAAAAGAATCCCAGCACCAAAATA

TTGTTTTCTTCACCAACCATCAGTTCATAGGTCCATTCTCTTAGCGCAACTACAGAG

AACAGGGGCACAAACAGGCAAAAAACGGGCACAACCTCAATGGAGTGATGCAA

CCTGCCTGGAGTAAATGATGACACAAGGCAATTGACCCACGCATGTATCTATCTCA

TTTTCTTACACCTTCTATTACCTTCTGCTCTCTCTGATTTGGAAAAAGCTGAAAAAA

AAGGTTGAAACCAGTTCCCTGAAATTATTCCCCTACTTGACTAATAAGTATATAAAG

ACGGTAGGTATTGATTGTAATTCTGTAAATCTATTTCTTAAACTTCTTAAATTCTACT

TTTATAGTTAGTCTTTTTTTAGTTTTAAAACACCAAGAACTTAGTTTCGAATAAAC

ACACATAAACAAACAAAGAATTC p425-GFP_-1fs_mCherry:

(SEQ ID NO: 732)
ATGTCTAAAGGTGAAGAATTATTCACTGGTGTTGTCCCAATTTTGGTTGAATTAGAT

GGTGATGTTAATGGTCACAAATTTTCTGTCTCCGGTGAAGGTGAAGGTGATGCTAC

TTACGGTAAATTGACCTTAAAATTTATTTGTACTACTGGTAAATTGCCAGTTCCATG

GCCAACCTTAGTCACTACTTTCGGTTATGGTGTTCAATGTTTTGCTAGATACCCAGA

TCATATGAAACAACATGACTTTTTCAAGTCTGCCATGCCAGAAGGTTATGTTCAAG

AAAGAACTATTTTTTTCAAAGATGACGGTAACTACAAGACCAGAGCTGAAGTCAA

GTTTGAAGGTGATACCTTAGTTAATAGAATCGAATTAAAAGGTATTGATTTTAAAGA

AGATGGTAACATTTTAGGTCACAAATTGGAATACAACTATAACTCTCACAATGTTTA

CATCATGGCTGACAAACAAAAGAATGGTATCAAAGTTAACTTCAAAATTAGACAC

AACATTGAAGATGGTTCTGTTCAATTAGCTGACCATTATCAACAAAATACTCCAATT

GGTGATGGTCCAGTCTTGTTACCAGACAACCATTACTTATCCACTCAATCTGCCTTA

TCCAAAGATCCAAACGAAAAGAGAGACCACATGGTCTTGTTAGAATTTGTTACTG

CTGCTGGTATTACCCATGGTATGGATGAATTGTACAAAGCTAGCAAACCTGGGTCA

ATCCTTGGGGCCCAGACTGAGCACGTGATGGCAGAGCACAGGACGTCATGGTTT

*CAAAAGGTGAAGAAGATAATATGGCTATTATTAAAGAATTTATGAGATTTAAAGTTCATATG*

*GAAGGTTCAGTTAATGGTCATGAATTTGAAATTGAAGGTGAAGGTGAAGGTAGACCATAT*

*GAAGGTACTCAAACTGCTAAATTGAAAGTTACTAAAGGTGGTCCATTACCATTTGCTTGG*

*GATATTTTGTCACCACAATTTATGTATGGTTCAAAAGCTTATGTTAAACATCCAGCTGATAT*

*TCCAGATTATTTAAAATTGTCATTTCCAGAAGGTTTTAAATGGGAAAGAGTTATGAATTTT*

*GAAGATGGTGGTGTTGTTACTGTTACTCAAGATTCATCATTACAAGATGGTGAATTTATTT*

*ATAAAGTTAAATTGAGAGGTACTAATTTTCCATCAGATGGTCCAGTTATGCAAAAAAAAAC*

*TATGGGTTGGGAAGCTTCATCAGAAAGAATGTATCCAGAAGATGGTGCTTTAAAAGGTG*

*AAATTAAACAAAGATTGAAATTAAAAGATGGTGGTCATTATGATGCTGAAGTTAAAACTAC*

*TTATAAAGCTAAAAAACCAGTTCAATTACCAGGTGCTTATAATGTTAATATTAAATTGGATAT*

*TACTTCACATAATGAAGATTATACTATTGTTGAACAATATGAAAGAGCTGAAGGTAGACAT*

*TCAACTGGTGGTATGGATGAATTATATAAAGGTACCGCTCGAGCAGCTGTGATTGATTGA*

GTCGACTTGGTTGAACACGTTGCCAAGGCTTAAGTGAATTTACTTTAAATCTTGCA

TTTAAATAAATTTTCTTTTTATAGCTTTATGACTTAGTTTCAATTTATATACTATTTTA

-continued

```
ATGACATTTTCGATTCGGATCCACTAGTTCTAGAGCGGCCGCCACCGCGGTGGAGC
TCCAGCTTTTGTTCCCTTTAGTGAGGGTTAATTGCGCGCTTGGCGTAATCATGGTCA
TAGCTGTTTCCTGTGTGAAATTGTTATCCGCTCACAATTCCACACAACATAGGAGC
CGGAAGCATAAAGTGTAAAGCCTGGGGTGCCTAATGAGTGAGGTAACTCACATTA
ATTGCGTTGCGCTCACTGCCCGCTTTCCAGTCGGGAAACCTGTCGTGCCAGCTGC
ATTAATGAATCGGCCAACGCGCGGGGAGAGGCGGTTTGCGTATTGGGCGCTCTTC
CGCTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAGG
AAAGAACATGTGAGCAAAAGGCCAGCAAAAGGCCAGGAACCGTAAAAAGGCCG
CGTTGCTGGCGTTTTTCCATAGGCTCCGCCCCCCTGACGAGCATCACAAAAATCGA
CGCTCAAGTCAGAGGTGGCGAAACCCGACAGGACTATAAAGATACCAGGCGTTTC
CCCCTGGAAGCTCCCTCGTGCGCTCTCCTGTTCCGACCCTGCCGCTTACCGGATAC
CTGTCCGCCTTTCTCCCTTCGGGAAGCGTGGCGCTTTCTCATAGCTCACGCTGTAG
GTATCTCAGTTCGGTGTAGGTCGTTCGCTCCAAGCTGGGCTGTGTGCACGAACCC
CCCGTTCAGCCCGACCGCTGCGCCTTATCCGGTAACTATCGTCTTGAGTCCAACCC
GGTAAGACACGACTTATCGCCACTGGCAGCAGCCACTGGTAACAGGATTAGCAGA
GCGAGGTATGTAGGCGGTGCTACAGAGTTCTTGAAGTGGTGGCCTAACTACGGCT
ACACTAGAAGGACAGTATTTGGTATCTGCGCTCTGCTGAAGCCAGTTACCTTCGGA
AAAAGAGTTGGTAGCTCTTGATCCGGCAAACAAACCACCGCTGGTAGCGGTGGTT
TTTTTGTTTGCAAGCAGCAGATTACGCGCAGAAAAAAAGGATCTCAAGAAGATCC
TTTGATCTTTTCTACGGGGTCTGACGCTCAGTGGAACGAAAACTCACGTTAAGGG
ATTTTGGTCATGAGATTATCAAAAAGGATCTTCACCTAGATCCTTTTAAATTAAAAA
TGAAGTTTTAAATCAATCTAAAGTATATATGAGTAAACTTGGTCTGACAGTTACCAA
TGCTTAATCAGTGAGGCACCTATCTCAGCGATCTGTCTATTTCGTTCATCCATAGTT
GCCTGACTCCCCGTCGTGTAGATAACTACGATACGGGAGGGCTTACCATCTGGCCC
CAGTGCTGCAATGATACCGCGAGACCCACGCTCACCGGCTCCAGATTTATCAGCA
ATAAACCAGCCAGCCGGAAGGGCCGAGCGCAGAAGTGGTCCTGCAACTTTATCCG
CCTCCATCCAGTCTATTAATTGTTGCCGGGAAGCTAGAGTAAGTAGTTCGCCAGTT
AATAGTTTGCGCAACGTTGTTGCCATTGCTACAGGCATCGTGGTGTCACGCTCGTC
GTTTGGTATGGCTTCATTCAGCTCCGGTTCCCAACGATCAAGGCGAGTTACATGAT
CCCCCATGTTGTGCAAAAAAGCGGTTAGCTCCTTCGGTCCTCCGATCGTTGTCAGA
AGTAAGTTGGCCGCAGTGTTATCACTCATGGTTATGGCAGCACTGCATAATTCTCTT
ACTGTCATGCCATCCGTAAGATGCTTTTCTGTGACTGGTGAGTACTCAACCAAGTC
ATTCTGAGAATAGTGTATGCGGCGACCGAGTTGCTCTTGCCCGGCGTCAATACGGG
ATAATACCGCGCCACATAGCAGAACTTTAAAAGTGCTCATCATTGGAAAACGTTCT
TCGGGGCGAAAACTCTCAAGGATCTTACCGCTGTTGAGATCCAGTTCGATGTAAC
CCACTCGTGCACCCAACTGATCTTCAGCATCTTTTACTTTCACCAGCGTTTCTGGG
TGAGCAAAAACAGGAAGGCAAAATGCCGCAAAAAAGGGAATAAGGGCGACACG
GAAATGTTGAATACTCATACTCTTCCTTTTTCAATATTATTGAAGCATTTATCAGGGT
TATTGTCTCATGAGCGGATACATATTTGAATGTATTTAGAAAAATAAACAAATAGGG
GTTCCGCGCACATTTCCCCGAAAAGTGCCACCTGAACGAAGCATCTGTGCTTCATT
```

-continued

```
TTGTAGAACAAAAATGCAACGCGAGAGCGCTAATTTTTCAAACAAAGAATCTGAG

CTGCATTTTTACAGAACAGAAATGCAACGCGAAAGCGCTATTTTACCAACGAAGA

ATCTGTGCTTCATTTTTGTAAAACAAAAATGCAACGCGAGAGCGCTAATTTTTCAA

ACAAAGAATCTGAGCTGCATTTTTACAGAACAGAAATGCAACGCGAGAGCGCTAT

TTTACCAACAAAGAATCTATACTTCTTTTTTGTTCTACAAAAATGCATCCCGAGAGC

GCTATTTTTCTAACAAAGCATCTTAGATTACTTTTTTTCTCCTTTGTGCGCTCTATAA

TGCAGTCTCTTGATAACTTTTTGCACTGTAGGTCCGTTAAGGTTAGAAGAAGGCTA

CTTTGGTGTCTATTTTCTCTTCCATAAAAAAAGCCTGACTCCACTTCCCGCGTTTAC

TGATTACTAGCGAAGCTGCGGGTGCATTTTTTCAAGATAAAGGCATCCCCGATTATA

TTCTATACCGATGTGGATTGCGCATACTTTGTGAACAGAAAGTGATAGCGTTGATG

ATTCTTCATTGGTCAGAAAATTATGAACGGTTTCTTCTATTTTGTCTCTATATACTAC

GTATAGGAAATGTTTACATTTTCGTATTGTTTTCGATTCACTCTATGAATAGTTCTTA

CTACAATTTTTTTGTCTAAAGAGTAATACTAGAGATAAACATAAAAAATGTAGAGG

TCGAGTTTAGATGCAAGTTCAAGGAGCGAAAGGTGGATGGGTAGGTTATATAGGG

ATATAGCACAGAGATATATAGCAAAGAGATACTTTTGAGCAATGTTTGTGGAAGCG

GTATTCGCAATATTTTAGTAGCTCGTTACAGTCCGGTGCGTTTTTGGTTTTTTGAAA

GTGCGTCTTCAGAGCGCTTTTGGTTTTCAAAAGCGCTCTGAAGTTCCTATACTTTC

TAGAGAATAGGAACTTCGGAATAGGAACTTCAAAGCGTTTCCGAAAACGAGCGCT

TCCGAAAATGCAACGCGAGCTGCGCACATACAGCTCACTGTTCACGTCGCACCTA

TATCTGCGTGTTGCCTGTATATATATACATGAGAAGAACGGCATAGTGCGTGTTTA

TGCTTAAATGCGTACTTATATGCGTCTATTTATGTAGGATGAAAGGTAGTCTAGTAC

CTCCTGTGATATTATCCCATTCCATGCGGGGTATCGTATGCTTCCTTCAGCACTACCC

TTTAGCTGTTCTATATGCTGCCACTCCTCAATTGGATTAGTCTCATCCTTCAATGCTA

TCATTTCCTTTGATATTGGATCATACTAAGAAACCATTATTATCATGACATTAACCTA

TAAAAATAGGCGTATCACGAGGCCCTTTCGTCTCGCGCGTTTCGGTGATGACGGTG

AAAACCTCTGACACATGCAGCTCCCGGAGACGGTCACAGCTTGTCTGTAAGCGGA

TGCCGGGAGCAGACAAGCCCGTCAGGGCGCGTCAGCGGGTGTTGGCGGGTGTCG

GGGCTGGCTTAACTATGCGGCATCAGAGCAGATTGTACTGAGAGTGCACCATATCG

ACTACGTCGTAAGGCCGTTTCTGACAGAGTAAAATTCTTGAGGGAACTTTCACCAT

TATGGGAAATGCTTCAAGAAGGTATTGACTTAAACTCCATCAAATGGTCAGGTCAT

TGAGTGTTTTTTATTTGTTGTATTTTTTTTTTTAGAGAAAATCCTCCAATATCAAA

TTAGGAATCGTAGTTTCATGATTTTCTGTTACACCTAACTTTTTGTGTGGTGCCCTC

CTCCTTGTCAATATTAATGTTAAAGTGCAATTCTTTTTCCTTATCACGTTGAGCCATT

AGTATCAATTTGCTTACCTGTATTCCTTTACTATCCTCCTTTTTCTCCTTCTTGATAA

ATGTATGTAGATTGCGTATATAGTTTCGTCTACCCTATGAACATATTCCATTTTGTAAT

TTCGTGTCGTTTCTATTATGAATTTCATTTATAAAGTTTATGTACAAATATCATAAAA

AAAGAGAATCTTTTTAAGCAAGGATTTTCTTAACTTCTTCGGCGACAGCATCACCG

ACTTCGGTGGTACTGTTGGAACCACCTAAATCACCAGTTCTGATACCTGCATCCAA

AACCTTTTTAACTGCATCTTCAATGGCCTTACCTTCTTCAGGCAAGTTCAATGACA

ATTTCAACATCATTGCAGCAGACAAGATAGTGGCGATAGGGTCAACCTTATTCTTT
```

-continued

```
GGCAAATCTGGAGCAGAACCGTGGCATGGTTCGTACAAACCAAATGCGGTGTTCT
TGTCTGGCAAAGAGGCCAAGGACGCAGATGGCAACAAACCCAAGGAACCTGGGA
TAACGGAGGCTTCATCGGAGATGATATCACCAAACATGTTGCTGGTGATTATAATAC
CATTTAGGTGGGTTGGGTTCTTAACTAGGATCATGGCGGCAGAATCAATCAATTGA
TGTTGAACCTTCAATGTAGGGAATTCGTTCTTGATGGTTTCCTCCACAGTTTTTCTC
CATAATCTTGAAGAGGCCAAAAGATTAGCTTTATCCAAGGACCAAATAGGCAATGG
TGGCTCATGTTGTAGGGCCATGAAAGCGGCCATTCTTGTGATTCTTTGCACTTCTG
GAACGGTGTATTGTTCACTATCCCAAGCGACACCATCACCATCGTCTTCCTTTCTCT
TACCAAAGTAAATACCTCCCACTAATTCTCTGACAACAACGAAGTCAGTACCTTTA
GCAAATTGTGGCTTGATTGGAGATAAGTCTAAAAGAGAGTCGGATGCAAAGTTAC
ATGGTCTTAAGTTGGCGTACAATTGAAGTTCTTTACGGATTTTTAGTAAACCTTGTT
CAGGTCTAACACTACCGGTACCCCATTTAGGACCAGCCACAGCACCTAACAAAAC
GGCATCAACCTTCTTGGAGGCTTCCAGCGCCTCATCTGGAAGTGGGACACCTGTA
GCATCGATAGCAGCACCACCAATTAAATGATTTTCGAAATCGAACTTGACATTGGA
ACGAACATCAGAAATAGCTTTAAGAACCTTAATGGCTTCGGCTGTGATTTCTTGAC
CAACGTGGTCACCTGGCAAAACGACGATCTTCTTAGGGGCAGACATAGGGGCAG
ACATTAGAATGGTATATCCTTGAAATATATATATATATTGCTGAAATGTAAAAGGTAA
GAAAAGTTAGAAAGTAAGACGATTGCTAACCACCTATTGGAAAAAACAATAGGTC
CTTAAATAATATTGTCAACTTCAAGTATTGTGATGCAAGCATTTAGTCATGAACGCT
TCTCTATTCTATATGAAAAGCCGGTTCCGGCCTCTCACCTTTCCTTTTTCTCCCAATT
TTTCAGTTGAAAAAGGTATATGCGTCAGGCGACCTCTGAAATTAACAAAAAATTTC
CAGTCATCGAATTTGATTCTGTGCGATAGCGCCCCTGTGTGTTCTCGTTATGTTGAG
GAAAAAAATAATGGTTGCTAAGAGATTCGAACTCTTGCATCTTACGATACCTGAGT
ATTCCCACAGTTAACTGCGGTCAAGATATTTCTTGAATCAGGCGCCTTAGACCGCT
CGGCCAAACAACCAATTACTTGTTGAGAAATAGAGTATAATTATCCTATAAATATAA
CGTTTTTGAACACACATGAACAAGGAAGTACAGGACAATTGATTTTGAAGAGAAT
GTGGATTTTGATGTAATTGTTGGGATTCCATTTTTAATAAGGCAATAATATTAGGTAT
GTGGATATACTAGAAGTTCTCCTCGACCGTCGATATGCGGTGTGAAATACCGCACA
GATGCGTAAGGAGAAAATACCGCATCAGGAAATTGTAAACGTTAATATTTTGTTAA
AATTCGCGTTAAATTTTTGTTAAATCAGCTCATTTTTTAACCAATAGGCCGAAATCG
GCAAAATCCCTTATAAATCAAAAGAATAGACCGAGATAGGGTTGAGTGTTGTTCCA
GTTTGGAACAAGAGTCCACTATTAAAGAACGTGGACTCCAACGTCAAAGGGCGA
AAAACCGTCTATCAGGGCGATGGCCCACTACGTGAACCATCACCCTAATCAAGTTT
TTTGGGGTCGAGGTGCCGTAAAGCACTAAATCGGAACCCTAAAGGGAGCCCCCGA
TTTAGAGCTTGACGGGGAAAGCCGGCGAACGTGGCGAGAAAGGAAGGGAAGAA
AGCGAAAGGAGCGGGCGCTAGGGCGCTGGCAAGTGTAGCGGTCACGCTGCGCGT
AACCACCACACCCGCCGCGCTTAATGCGCCGCTACAGGGCGCGTCGCGCCATTCG
CCATTCAGGCTGCGCAACTGTTGGGAAGGGCGATCGGTGCGGGCCTCTTCGCTAT
TACGCCAGCTGGCGAAAGGGGGATGTGCTGCAAGGCGATTAAGTTGGGTAACGCC
AGGGTTTTCCCAGTCACGACGTTGTAAAACGACGGCCAGTGAGCGCGCGTAATAC
GACTCACTATAGGGCGAATTGGGTACCGGGCCCCCCCTCGAGGTCGACGGTATCG
```

-continued

```
ATAAGCTTGATATCGAATTCCTGCAGCCCGGGGGATCCGTTAGAATCATTTTGAATA

AAAAACACGCTTTTTCAGTTCGAGTTTATCATTATCAATACTGCCATTTCAAAGAAT

ACGTAAATAATTAATAGTAGTGATTTTCCTAACTTTATTTAGTCAAAAAATTAGCCTT

TTAATTCTGCTGTAACCCGTACATGCCCAAAATAGGGGGCGGGTTACACAGAATAT

ATAACATCGTAGGTGTCTGGGTGAACAGTTTATTCCTGGCATCCACTAAATATAATG

GAGCCCGCTTTTTAAGCTGGCATCCAGAAAAAAAAAGAATCCCAGCACCAAAATA

TTGTTTTCTTCACCAACCATCAGTTCATAGGTCCATTCTCTTAGCGCAACTACAGAG

AACAGGGGCACAAACAGGCAAAAAACGGGCACAACCTCAATGGAGTGATGCAA

CCTGCCTGGAGTAAATGATGACACAAGGCAATTGACCCACGCATGTATCTATCTCA

TTTTCTTACACCTTCTATTACCTTCTGCTCTCTCTGATTTGGAAAAAGCTGAAAAAA

AAGGTTGAAACCAGTTCCCTGAAATTATTCCCCTACTTGACTAATAAGTATATAAAG

ACGGTAGGTATTGATTGTAATTCTGTAAATCTATTTCTTAAACTTCTTAAATTCTACT

TTTATAGTTAGTCTTTTTTTAGTTTTAAAACACCAAGAACTTAGTTTCGAATAAAC

ACACATAAACAAACAAAGAATTC
```

KEY:
GFP open reading frame
Linker containng stop codon +1 frameshift, or −1 frameshift
*mCherry open reading frame*
<u>Photospacer (underlined)</u>
PAM (boldfaced)

30

DNA sequences of mammalian prime editor plasmids and example PEgRNA plasmid
pCMV-PE1:

(SEQ ID NO: 733)
```
ATGAAACGGACAGCCGACGGAAGCGAGTTCGAGTCACCAAAGAAGAAGCGGAA

AGTCGACAAGAAGTACAGCATCGGCCTGGACATCGGCACCAACTCTGTGGGCTGG

GCCGTGATCACCGACGAGTACAAGGTGCCCAGCAAGAAATTCAAGGTGCTGGGC

AACACCGACCGGCACAGCATCAAGAAGAACCTGATCGGAGCCCTGCTGTTCGAC

AGCGGCGAAACAGCCGAGGCCACCCGGCTGAAGAGAACCGCCAGAAGAAGATA

CACCAGACGGAAGAACCGGATCTGCTATCTGCAAGAGATCTTCAGCAACGAGATG

GCCAAGGTGGACGACAGCTTCTTCCACAGACTGGAAGAGTCCTTCCTGGTGGAA

GAGGATAAGAAGCACGAGCGGCACCCCATCTTCGGCAACATCGTGGACGAGGTG

GCCTACCACGAGAAGTACCCCACCATCTACCACCTGAGAAAGAAACTGGTGGACA

GCACCGACAAGGCCGACCTGCGGCTGATCTATCTGGCCCTGGCCCACATGATCAA

GTTCCGGGGCCACTTCCTGATCGAGGGCGACCTGAACCCCGACAACAGCGACGT

GGACAAGCTGTTCATCCAGCTGGTGCAGACCTACAACCAGCTGTTCGAGGAAAAC

CCCATCAACGCCAGCGGCGTGGACGCCAAGGCCATCCTGTCTGCCAGACTGAGCA

AGAGCAGACGGCTGGAAAATCTGATCGCCCAGCTGCCCGGCGAGAAGAAGAATG

GCCTGTTCGGAAACCTGATTGCCCTGAGCCTGGGCCTGACCCCCAACTTCAAGAG

CAACTTCGACCTGGCCGAGGATGCCAAACTGCAGCTGAGCAAGGACACCTACGA

CGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGA

ACACCGAGATCACCAAGGCCCCCCTGAGCGCCTCTATGATCAAGAGATACGACGA
```

-continued

```
GCACCACCAGGACCTGACCCTGCTGAAAGCTCTCGTGCGGCAGCAGCTGCCTGA

GAAGTACAAAGAGATTTTCTTCGACCAGAGCAAGAACGGCTACGCCGGCTACATT

GACGGCGGAGCCAGCCAGGAAGAGTTCTACAAGTTCATCAAGCCCATCCTGGAA

AAGATGGACGGCACCGAGGAACTGCTCGTGAAGCTGAACAGAGAGGACCTGCTG

CGGAAGCAGCGGACCTTCGACAACGGCAGCATCCCCCACCAGATCCACCTGGGA

GAGCTGCACGCCATTCTGCGGCGGCAGGAAGATTTTTACCCATTCCTGAAGGACA

ACCGGGAAAAGATCGAGAAGATCCTGACCTTCCGCATCCCCTACTACGTGGGCCC

TCTGGCCAGGGGAAACAGCAGATTCGCCTGGATGACCAGAAAGAGCGAGGAAAC

CATCACCCCCTGGAACTTCGAGGAAGTGGTGGACAAGGGCGCTTCCGCCCAGAG

CTTCATCGAGCGGATGACCAACTTCGATAAGAACCTGCCCAACGAGAAGGTGCTG

CCCAAGCACAGCCTGCTGTACGAGTACTTCACCGTGTATAACGAGCTGACCAAAG

TGAAATACGTGACCGAGGGAATGAGAAAGCCCGCCTTCCTGAGCGGCGAGCAGA

AAAAGGCCATCGTGGACCTGCTGTTCAAGACCAACCGGAAAGTGACCGTGAAGC

AGCTGAAAGAGGACTACTTCAAGAAAATCGAGTGCTTCGACTCCGTGGAAATCTC

CGGCGTGGAAGATCGGTTCAACGCCTCCCTGGGCACATACCACGATCTGCTGAAA

ATTATCAAGGACAAGGACTTCCTGGACAATGAGGAAAACGAGGACATTCTGGAAG

ATATCGTGCTGACCCTGACACTGTTTGAGGACAGAGAGATGATCGAGGAACGGCT

GAAAACCTATGCCCACCTGTTCGACGACAAAGTGATGAAGCAGCTGAAGCGGCG

GAGATACACCGGCTGGGGCAGGCTGAGCCGGAAGCTGATCAACGGCATCCGGGA

CAAGCAGTCCGGCAAGACAATCCTGGATTTCCTGAAGTCCGACGGCTTCGCCAAC

AGAAACTTCATGCAGCTGATCCACGACGACAGCCTGACCTTTAAAGAGGACATCC

AGAAAGCCCAGGTGTCCGGCCAGGGCGATAGCCTGCACGAGCACATTGCCAATCT

GGCCGGCAGCCCCGCCATTAAGAAGGGCATCCTGCAGACAGTGAAGGTGGTGGA

CGAGCTCGTGAAAGTGATGGGCCGGCACAAGCCCGAGAACATCGTGATCGAAAT

GGCCAGAGAGAACCAGACCACCCAGAAGGGACAGAAGAACAGCCGCGAGAGAA

TGAAGCGGATCGAAGAGGGCATCAAAGAGCTGGGCAGCCAGATCCTGAAAGAAC

ACCCCGTGGAAAACACCCAGCTGCAGAACGAGAAGCTGTACCTGTACTACCTGCA

GAATGGGCGGGATATGTACGTGGACCAGGAACTGGACATCAACCGGCTGTCCGAC

TACGATGTGGACGCTATCGTGCCTCAGAGCTTTCTGAAGGACGACTCCATCGACA

ACAAGGTGCTGACCAGAAGCGACAAGAACCGGGGCAAGAGCGACAACGTGCCC

TCCGAAGAGGTCGTGAAGAAGATGAAGAACTACTGGCGGCAGCTGCTGAACGCC

AAGCTGATTACCCAGAGAAAGTTCGACAATCTGACCAAGGCCGAGAGAGGCGGC

CTGAGCGAACTGGATAAGGCCGGCTTCATCAAGAGACAGCTGGTGGAAACCCGG

CAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGC

TGGTGTCCGATTTCCGGAAGGATTTCCAGTTTTACAAAGTGCGCGAGATCAACAA

CTACCACCACGCCCACGACGCCTACCTGAACGCCGTCGTGGGAACCGCCCTGATC

AAAAAGTACCCTAAGCTGGAAAGCGAGTTCGTGTACGGCGACTACAAGGTGTACG

ACGTGCGGAAGATGATCGCCAAGAGCGAGCAGGAAATCGGCAAGGCTACCGCCA

AGTACTTCTTCTACAGCAACATCATGAACTTTTTCAAGACCGAGATTACCCTGGCC

AACGGCGAGATCCGGAAGCGGCCTCTGATCGAGACAAACGGCGAAACCGGGGAG
```

-continued

ATCGTGTGGGATAAGGGCCGGGATTTTGCCACCGTGCGGAAAGTGCTGAGCATGC
CCCAAGTGAATATCGTGAAAAAGACCGAGGTGCAGACAGGCGGCTTCAGCAAAG
AGTCTATCCTGCCCAAGAGGAACAGCGATAAGCTGATCGCCAGAAAGAAGGACT
GGGACCCTAAGAAGTACGGCGGCTTCGACAGCCCCACCGTGGCCTATTCTGTGCT
GGTGGTGGCCAAAGTGGAAAAGGGCAAGTCCAAGAAACTGAAGAGTGTGAAAG
AGCTGCTGGGGATCACCATCATGGAAAGAAGCAGCTTCGAGAAGAATCCCATCGA
CTTTCTGGAAGCCAAGGGCTACAAAGAAGTGAAAAAGGACCTGATCATCAAGCT
GCCTAAGTACTCCCTGTTCGAGCTGGAAAACGGCCGGAAGAGAATGCTGGCCTCT
GCCGGCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGATAATG
AGCAGAAACAGCTGTTTGTGGAACAGCACAAGCACTACCTGGACGAGATCATCG
AGCAGATCAGCGAGTTCTCCAAGAGAGTGATCCTGGCCGACGCTAATCTGGACAA
AGTGCTGTCCGCCTACAACAAGCACCGGGATAAGCCCATCAGAGAGCAGGCCGA
GAATATCATCCACCTGTTTACCCTGACCAATCTGGGAGCCCCTGCCGCCTTCAAGT
ACTTTGACACCACCATCGACCGGAAGAGGTACACCAGCACCAAAGAGGTGCTGG
ACGCCACCCTGATCCACCAGAGCATCACCGGCCTGTACGAGACACGGATCGACCT
GTCTCAGCTGGGAGGTGA*CTCTGGAGGATCTAGCGGAGGATCCTCTGGCAGCGAGA*
*CACCAGGAACAAGCGAGTCAGCAACACCAGAGAGCAGTGGCGGCAGCAGCGGCGGC*
*AGCAGC*<u>ACCCTAAATATAGAAGATGAGTATCGGCTACATGAGACCTCAAAAGA</u>
<u>GCCAGATGTTTCTCTAGGGTCCACATGGCTGTCTGATTTTCCTCAGGCCTGG</u>
<u>GCGGAAACCGGGGGCATGGGACTGGCAGTTCGCCAAGCTCCTCTGATCATA</u>
<u>CCTCTGAAAGCAACCTCTACCCCCGTGTCCATAAAACAATACCCCATGTCACA</u>
<u>AGAAGCCAGACTGGGGATCAAGCCCCACATACAGAGACTGTTGGACCAGGG</u>
<u>AATACTGGTACCCTGCCAGTCCCCCTGGAACACGCCCCTGCTACCCGTTAAG</u>
<u>AAACCAGGGACTAATGATTATAGGCCTGTCCAGGATCTGAGAGAAGTCAACA</u>
<u>AGCGGGTGGAAGACATCCACCCCACCGTGCCCAACCCTTACAACCTCTTGAG</u>
<u>CGGGCTCCCACCGTCCCACCAGTGGTACACTGTGCTTGATTTAAAGGATGCC</u>
<u>TTTTTCTGCCTGAGACTCCACCCCACCAGTCAGCCTCTCTTCGCCTTTGAGT</u>
<u>GGAGAGATCCAGAGATGGGAATCTCAGGACAATTGACCTGGACCAGACTCC</u>
<u>CACAGGGTTTCAAAAACAGTCCCACCCTGTTTGATGAGGCACTGCACAGAGA</u>
<u>CCTAGCAGACTTCCGGATCCAGCACCCAGACTTGATCCTGCTACAGTACGTG</u>
<u>GATGACTTACTGCTGGCCGCCACTTCTGAGCTAGACTGCCAACAAGGTACTC</u>
<u>GGGCCCTGTTACAAACCCTAGGGAACCTCGGGTATCGGGCCTCGGCCAAGA</u>
<u>AAGCCCAAATTTGCCAGAAACAGGTCAAGTATCTGGGGTATCTTCTAAAAGA</u>
<u>GGGTCAGAGATGGCTGACTGAGGCCAGAAAAGAGACTGTGATGGGGCAGCC</u>
<u>TACTCCGAAGACCCCTCGACAACTAAGGGAGTTCCTAGGGACGGCAGGCTT</u>
<u>CTGTCGCCTCTGGATCCCTGGGTTTGCAGAAATGGCAGCCCCCCTGTACCCT</u>
<u>CTCACCAAAACGGGGACTCTGTTTAATTGGGGCCCAGACCAACAAAAGGCCT</u>
<u>ATCAAGAAATCAAGCAAGCTCTTCTAACTGCCCCAGCCCTGGGGTTGCCAGA</u>
<u>TTTGACTAAGCCCTTTGAACTCTTTGTCGACGAGAAGCAGGGCTACGCCAAA</u>

-continued

<u>GGTGTCCTAACGCAAAAACTGGGACCTTGGCGTCGGCCGGTGGCCTACCTG</u>

<u>TCCAAAAAGCTAGACCCAGTAGCAGCTGGGTGGCCCCCTTGCCTACGGATGG</u>

<u>TAGCAGCCATTGCCGTACTGACAAAGGATGCAGGCAAGCTAACCATGGGACA</u>

<u>GCCACTAGTCATTCTGGCCCCCCATGCAGTAGAGGCACTAGTCAAACAACCC</u>

<u>CCCGACCGCTGGCTTTCCAACGCCCGGATGACTCACTATCAGGCCTTGCTTT</u>

<u>TGGACACGGACCGGGTCCAGTTCGGACCGGTGGTAGCCCTGAACCCGGCTA</u>

<u>CGCTGCTCCCACTGCCTGAGGAAGGGCTGCAACACAACTGCCTTGATATCCT</u>

<u>GGCCGAAGCCCACGGAACCCGACCCGACCTAACGGACCAGCCGCTCCCAGA</u>

<u>CGCCGACCACACCTGGTACACGGATGGAAGCAGTCTCTTACAAGAGGGACA</u>

<u>GCGTAAGGCGGGAGCTGCGGTGACCACCGAGACCGAGGTAATCTGGGCTAA</u>

<u>AGCCCTGCCAGCCGGGACATCCGCTCAGCGGGCTGAACTGATAGCACTCAC</u>

<u>CCAGGCCCTAAAGATGGCAGAAGGTAAGAAGCTAAATGTTTATACTGATAGC</u>

<u>CGTTATGCTTTTGCTACTGCCCATATCCATGGAGAAATATACAGAAGGCGTGG</u>

<u>GTTGCTCACATCAGAAGGCAAAGAGATCAAAAATAAAGACGAGATCTTGGCC</u>

<u>CTACTAAAAGCCCTCTTTCTGCCCAAAAGACTTAGCATAATCCATTGTCCAGG</u>

<u>ACATCAAAAGGGACACAGCGCCGAGGCTAGAGGCAACCGGATGGCTGACCA</u>

<u>AGCGGCCCGAAAGGCAGCCATCACAGAGACTCCAGACACCTCTACCCTCCT</u>

CATAGAAAATTCATCACCCTCTGGCGGCTCAAAAAGAACCGCCGACGGCAGC

<u>GAATTCGAGCCCAAGAAGAAGAGGAAAGTCTAA</u>CCGGTCATCATCACCATCAC

CATTGAGTTTAAACCCGCTGATCAGCCTCGACTGTGCCTTCTAGTTGCCAGCCATC

TGTTGTTTGCCCCTCCCCCGTGCCTTCCTTGACCCTGGAAGGTGCCACTCCCACTG

TCCTTTCCTAATAAAATGAGAAAATTGCATCGCATTGTCTGAGTAGGTGTCATTCTA

TTCTGGGGGTGGGGTGGGGCAGGACAGCAAGGGGGAGGATTGGGAAGACAATA

GCAGGCATGCTGGGGATGCGGTGGGCTCTATGGCTTCTGAGGCGGAAAGAACCAG

CTGGGGCTCGATACCGTCGACCTCTAGCTAGAGCTTGGCGTAATCATGGTCATAGC

TGTTTCCTGTGTGAAATTGTTATCCGCTCACAATTCCACACAACATACGAGCCGGA

AGCATAAAGTGTAAAGCCTAGGGTGCCTAATGAGTGAGCTAACTCACATTAATTGC

GTTGCGCTCACTGCCCGCTTTCCAGTCGGGAAACCTGTCGTGCCAGCTGCATTAAT

GAATCGGCCAACGCGCGGGGAGAGGCGGTTTGCGTATTGGGCGCTCTTCCGCTTC

CTCGCTCACTGACTCGCTGCGCTCGGTCGTTCGGCTGCGGCGAGCGGTATCAGCT

CACTCAAAGGCGGTAATACGGTTATCCACAGAATCAGGGGATAACGCAGGAAAGA

ACATGTGAGCAAAAGGCCAGCAAAAGGCCAGGAACCGTAAAAAGGCCGCGTTGC

TGGCGTTTTTCCATAGGCTCCGCCCCCCTGACGAGCATCACAAAAATCGACGCTCA

AGTCAGAGGTGGCGAAACCCGACAGGACTATAAAGATACCAGGCGTTTCCCCCTG

GAAGCTCCCTCGTGCGCTCTCCTGTTCCGACCCTGCCGCTTACCGGATACCTGTCC

GCCTTTCTCCCTTCGGGAAGCGTGGCGCTTTCTCATAGCTCACGCTGTAGGTATCT

CAGTTCGGTGTAGGTCGTTCGCTCCAAGCTGGGCTGTGTGCACGAACCCCCCGTT

CAGCCCGACCGCTGCGCCTTATCCGGTAACTATCGTCTTGAGTCCAACCCGGTAAG

ACACGACTTATCGCCACTGGCAGCAGCCACTGGTAACAGGATTAGCAGAGCGAGG

TATGTAGGCGGTGCTACAGAGTTCTTGAAGTGGTGGCCTAACTACGGCTACACTAG

AAGAACAGTATTTGGTATCTGCGCTCTGCTGAAGCCAGTTACCTTCGGAAAAAGA

-continued

```
GTTGGTAGCTCTTGATCCGGCAAACAAACCACCGCTGGTAGCGGTGGTTTTTTTGT

TTGCAAGCAGCAGATTACGCGCAGAAAAAAGGATCTCAAGAAGATCCTTTGATC

TTTTCTACGGGGTCTGACGCTCAGTGGAACGAAAACTCACGTTAAGGGATTTTGG

TCATGAGATTATCAAAAAGGATCTTCACCTAGATCCTTTTAAATTAAAAATGAAGTT

TTAAATCAATCTAAAGTATATATGAGTAAACTTGGTCTGACAGTTACCAATGCTTAA

TCAGTGAGGCACCTATCTCAGCGATCTGTCTATTTCGTTCATCCATAGTTGCCTGAC

TCCCCGTCGTGTAGATAACTACGATACGGGAGGGCTTACCATCTGGCCCCAGTGCT

GCAATGATACCGCGAGACCCACGCTCACCGGCTCCAGATTTATCAGCAATAAACCA

GCCAGCCGGAAGGGCCGAGCGCAGAAGTGGTCCTGCAACTTTATCCGCCTCCATC

CAGTCTATTAATTGTTGCCGGGAAGCTAGAGTAAGTAGTTCGCCAGTTAATAGTTT

GCGCAACGTTGTTGCCATTGCTACAGGCATCGTGGTGTCACGCTCGTCGTTTGGTA

TGGCTTCATTCAGCTCCGGTTCCCAACGATCAAGGCGAGTTACATGATCCCCCATG

TTGTGCAAAAAAGCGGTTAGCTCCTTCGGTCCTCCGATCGTTGTCAGAAGTAAGT

TGGCCGCAGTGTTATCACTCATGGTTATGGCAGCACTGCATAATTCTCTTACTGTCA

TGCCATCCGTAAGATGCTTTTCTGTGACTGGTGAGTACTCAACCAAGTCATTCTGA

GAATAGTGTATGCGGCGACCGAGTTGCTCTTGCCCGGCGTCAATACGGGATAATAC

CGCGCCACATAGCAGAACTTTAAAAGTGCTCATCATTGGAAAACGTTCTTCGGGG

CGAAAACTCTCAAGGATCTTACCGCTGTTGAGATCCAGTTCGATGTAACCCACTCG

TGCACCCAACTGATCTTCAGCATCTTTTACTTTCACCAGCGTTTCTGGGTGAGCAA

AAACAGGAAGGCAAAATGCCGCAAAAAAGGGAATAAGGGCGACACGGAAATGTT

GAATACTCATACTCTTCCTTTTTCAATATTATTGAAGCATTTATCAGGGTTATTGTCT

CATGAGCGGATACATATTTGAATGTATTTAGAAAAATAAACAAATAGGGGTTCCGC

GCACATTTCCCCGAAAAGTGCCACCTGACGTCGACGGATCGGGAGATCGATCTCC

CGATCCCCTAGGGTCGACTCTCAGTACAATCTGCTCTGATGCCGCATAGTTAAGCC

AGTATCTGCTCCCTGCTTGTGTGTTGGAGGTCGCTGAGTAGTGCGCGAGCAAAATT

TAAGCTACAACAAGGCAAGGCTTGACCGACAATTGCATGAAGAATCTGCTTAGGG

TTAGGCGTTTTGCGCTGCTTCGCGATGTACGGGCCAGATATACGCGTTGACATTGA

TTATTGACTAGTTATTAATAGTAATCAATTACGGGGTCATTAGTTCATAGCCCATATA

TGGAGTTCCGCGTTACATAACTTACGGTAAATGGCCCGCCTGGCTGACCGCCCAAC

GACCCCCGCCCATTGACGTCAATAATGACGTATGTTCCCATAGTAACGCCAATAGG

GACTTTCCATTGACGTCAATGGGTGGAGTATTTACGGTAAACTGCCCACTTGGCAG

TACATCAAGTGTATCATATGCCAAGTACGCCCCCTATTGACGTCAATGACGGTAAAT

GGCCCGCCTGGCATTATGCCCAGTACATGACCTTATGGGACTTTCCTACTTGGCAG

TACATCTACGTATTAGTCATCGCTATTACCATGGTGATGCGGTTTTGGCAGTACATC

AATGGGCGTGGATAGCGGTTTGACTCACGGGGATTTCCAAGTCTCCACCCCATTGA

CGTCAATGGGAGTTTGTTTTGGCACCAAAATCAACGGGACTTTCCAAAATGTCGT

AACAACTCCGCCCCATTGACGCAAATGGGCGGTAGGCGTGTACGGTGGGAGGTCT

ATATAAGCAGAGCTGGTTTAGTGAACCGTCAGATCCGCTAGAGATCCGCGGCCGCT

AATACGACTCACTATAGGGAGAGCCGCCACC
``` pCMV-PE2:

```
ATGAAACGGACAGCCGACGGAAGCGAGTTCGAGTCACCAAAGAAGAAGCGGAA      (SEQ ID NO: 734)
AGTCGACAAGAAGTACAGCATCGGCCTGGACATCGGCACCAACTCTGTGGGCTGG
GCCGTGATCACCGACGAGTACAAGGTGCCCAGCAAGAAATTCAAGGTGCTGGGC
AACACCGACCGGCACAGCATCAAGAAGAACCTGATCGGAGCCCTGCTGTTCGAC
AGCGGCGAAACAGCCGAGGCCACCCGGCTGAAGAGAACCGCCAGAAGAAGATA
CACCAGACGGAAGAACCGGATCTGCTATCTGCAAGAGATCTTCAGCAACGAGATG
GCCAAGGTGGACGACAGCTTCTTCCACAGACTGGAAGAGTCCTTCCTGGTGGAA
GAGGATAAGAAGCACGAGCGGCACCCCATCTTCGGCAACATCGTGGACGAGGTG
GCCTACCACGAGAAGTACCCCACCATCTACCACCTGAGAAAGAAACTGGTGGACA
GCACCGACAAGGCCGACCTGCGGCTGATCTATCTGGCCCTGGCCCACATGATCAA
GTTCCGGGGCCACTTCCTGATCGAGGGCGACCTGAACCCCGACAACAGCGACGT
GGACAAGCTGTTCATCCAGCTGGTGCAGACCTACAACCAGCTGTTCGAGGAAAAC
CCCATCAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAGAATG
GCCTGTTCGGAAACCTGATTGCCCTGAGCCTGGGCCTGACCCCCAACTTCAAGAG
CAACTTCGACCTGGCCGAGGATGCCAAACTGCAGCTGAGCAAGGACACCTACGA
CGACGACCTGGACAACCTGCTGGCCCAGATCGGCGACCAGTACGCCGACCTGTTT
CTGGCCGCCAAGAACCTGTCCGACGCCATCCTGCTGAGCGACATCCTGAGAGTGA
ACACCGAGATCACCAAGGCCCCCCTGAGCGCCTCTATGATCAAGAGATACGACGA
GCACCACCAGGACCTGACCCTGCTGAAAGCTCTCGTGCGGCAGCAGCTGCCTGA
GAAGTACAAAGAGATTTTCTTCGACCAGAGCAAGAACGGCTACGCCGGCTACATT
GACGGCGGAGCCAGCCAGGAAGAGTTCTACAAGTTCATCAAGCCCATCCTGGAA
AAGATGGACGGCACCGAGGAACTGCTCGTGAAGCTGAACAGAGAGGACCTGCTG
CGGAAGCAGCGGACCTTCGACAACGGCAGCATCCCCCACCAGATCCACCTGGGA
GAGCTGCACGCCATTCTGCGGCGGCAGGAAGATTTTTACCCATTCCTGAAGGACA
ACCGGGAAAAGATCGAGAAGATCCTGACCTTCCGCATCCCCTACTACGTGGGCCC
TCTGGCCAGGGGAAACAGCAGATTCGCCTGGATGACCAGAAAGAGCGAGGAAAC
CATCACCCCCTGGAACTTCGAGGAAGTGGTGGACAAGGGCGCTTCCGCCCAGAG
CTTCATCGAGCGGATGACCAACTTCGATAAGAACCTGCCCAACGAGAAGGTGCTG
CCCAAGCACAGCCTGCTGTACGAGTACTTCACCGTGTATAACGAGCTGACCAAAG
TGAAATACGTGACCGAGGGAATGAGAAAGCCCGCCTTCCTGAGCGGCGAGCAGA
AAAAGGCCATCGTGGACCTGCTGTTCAAGACCAACCGGAAAGTGACCGTGAAGC
AGCTGAAAGAGGACTACTTCAAGAAAATCGAGTGCTTCGACTCCGTGGAAATCTC
CGGCGTGGAAGATCGGTTCAACGCCTCCCTGGGCACATACCACGATCTGCTGAAA
ATTATCAAGGACAAGGACTTCCTGGACAATGAGGAAAACGAGGACATTCTGGAAG
ATATCGTGCTGACCCTGACACTGTTTGAGGACAGAGAGATGATCGAGGAACGGCT
GAAAACCTATGCCCACCTGTTCGACGACAAAGTGATGAAGCAGCTGAAGCGGCG
GAGATACACCGGCTGGGGCAGGCTGAGCCGGAAGCTGATCAACGGCATCCGGGA
CAAGCAGTCCGGCAAGACAATCCTGGATTTCCTGAAGTCCGACGGCTTCGCCAAC
AGAAACTTCATGCAGCTGATCCACGACGACAGCCTGACCTTTAAAGAGGACATCC
```

-continued

```
AGAAAGCCCAGGTGTCCGGCCAGGGCGATAGCCTGCACGAGCACATTGCCAATCT
GGCCGGCAGCCCCGCCATTAAGAAGGGCATCCTGCAGACAGTGAAGGTGGTGGA
CGAGCTCGTGAAAGTGATGGGCCGGCACAAGCCCGAGAACATCGTGATCGAAAT
GGCCAGAGAGAACCAGACCACCCAGAAGGGACAGAAGAACAGCCGCGAGAGAA
TGAAGCGGATCGAAGAGGGCATCAAAGAGCTGGGCAGCCAGATCCTGAAAGAAC
ACCCCGTGGAAAACACCCAGCTGCAGAACGAGAAGCTGTACCTGTACTACCTGCA
GAATGGGCGGGATATGTACGTGGACCAGGAACTGGACATCAACCGGCTGTCCGAC
TACGATGTGGACGCTATCGTGCCTCAGAGCTTTCTGAAGGACGACTCCATCGACA
ACAAGGTGCTGACCAGAAGCGACAAGAACCGGGGCAAGAGCGACAACGTGCCC
TCCGAAGAGGTCGTGAAGAAGATGAAGAACTACTGGCGGCAGCTGCTGAACGCC
AAGCTGATTACCCAGAGAAAGTTCGACAATCTGACCAAGGCCGAGAGAGGCGGC
CTGAGCGAACTGGATAAGGCCGGCTTCATCAAGAGACAGCTGGTGGAAACCCGG
CAGATCACAAAGCACGTGGCACAGATCCTGGACTCCCGGATGAACACTAAGTACG
ACGAGAATGACAAGCTGATCCGGGAAGTGAAAGTGATCACCCTGAAGTCCAAGC
TGGTGTCCGATTTCCGGAAGGATTTCCAGTTTTACAAAGTGCGCGAGATCAACAA
CTACCACCACGCCCACGACGCCTACCTGAACGCCGTCGTGGGAACCGCCCTGATC
AAAAAGTACCCTAAGCTGGAAAGCGAGTTCGTGTACGGCGACTACAAGGTGTACG
ACGTGCGGAAGATGATCGCCAAGAGCGAGCAGGAAATCGGCAAGGCTACCGCCA
AGTACTTCTTCTACAGCAACATCATGAACTTTTTCAAGACCGAGATTACCCTGGCC
AACGGCGAGATCCGGAAGCGGCCTCTGATCGAGACAAACGGCGAAACCGGGGAG
ATCGTGTGGGATAAGGGCCGGGATTTTGCCACCGTGCGGAAAGTGCTGAGCATGC
CCCAAGTGAATATCGTGAAAAAGACCGAGGTGCAGACAGGCGGCTTCAGCAAAG
AGTCTATCCTGCCCAAGAGGAACAGCGATAAGCTGATCGCCAGAAAGAAGGACT
GGGACCCTAAGAAGTACGGCGGCTTCGACAGCCCCACCGTGGCCTATTCTGTGCT
GGTGGTGGCCAAAGTGGAAAAGGGCAAGTCCAAGAAACTGAAGAGTGTGAAAG
AGCTGCTGGGGATCACCATCATGGAAAGAAGCAGCTTCGAGAAGAATCCCATCGA
CTTTCTGGAAGCCAAGGGCTACAAAGAAGTGAAAAAGGACCTGATCATCAAGCT
GCCTAAGTACTCCCTGTTCGAGCTGGAAAACGGCCGGAAGAGAATGCTGGCCTCT
GCCGGCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGATAATG
AGCAGAAACAGCTGTTTGTGGAACAGCACAAGCACTACCTGGACGAGATCATCG
AGCAGATCAGCGAGTTCTCCAAGAGAGTGATCCTGGCCGACGCTAATCTGGACAA
AGTGCTGTCCGCCTACAACAAGCACCGGGATAAGCCCATCAGAGAGCAGGCCGA
GAATATCATCCACCTGTTTACCCTGACCAATCTGGGAGCCCCTGCCGCCTTCAAGT
ACTTTGACACCACCATCGACCGGAAGAGGTACACCAGCACCAAAGAGGTGCTGG
ACGCCACCCTGATCCACCAGAGCATCACCGGCCTGTACGAGACACGGATCGACCT
GTCTCAGCTGGGAGGTGACTCTGGAGGATCTAGCGGAGGATCCTCTGGCAGCGAG
ACACCAGGAACAAGCGAGTCAGCAACACCAGAGAGCAGTGGCGGCAGCAGCGG
CGGCAGCAGCACCCTAAATATAGAAGATGAGTATCGGCTACATGAGACCTCAAAA
GAGCCAGATGTTTCTCTAGGGTCCACATGGCTGTCTGATTTTCCTCAGGCCTGGGC
```

-continued

```
GGAAACCGGGGGCATGGGACTGGCAGTTCGCCAAGCTCCTCTGATCATACCTCTG
AAAGCAACCTCTACCCCCGTGTCCATAAAACAATACCCCATGTCACAAGAAGCCA
GACTGGGGATCAAGCCCCACATACAGAGACTGTTGGACCAGGGAATACTGGTACC
CTGCCAGTCCCCCTGGAACACGCCCCTGCTACCCGTTAAGAAACCAGGGACTAAT
GATTATAGGCCTGTCCAGGATCTGAGAGAAGTCAACAAGCGGGTGGAAGACATCC
ACCCCACCGTGCCCAACCCTTACAACCTCTTGAGCGGGCTCCCACCGTCCCACCA
GTGGTACACTGTGCTTGATTTAAAGGATGCCTTTTTCTGCCTGAGACTCCACCCCA
CCAGTCAGCCTCTCTTCGCCTTTGAGTGGAGAGATCCAGAGATGGGAATCTCAGG
ACAATTGACCTGGACCAGACTCCCACAGGGTTTCAAAAACAGTCCCACCCTGTTT
AATGAGGCACTGCACAGAGACCTAGCAGACTTCCGGATCCAGCACCCAGACTTGA
TCCTGCTACAGTACGTGGATGACTTACTGCTGGCCGCCACTTCTGAGCTAGACTGC
CAACAAGGTACTCGGGCCCTGTTACAAACCCTAGGGAACCTCGGGTATCGGGCCT
CGGCCAAGAAAGCCCAAATTTGCCAGAAACAGGTCAAGTATCTGGGGTATCTTCT
AAAAGAGGGTCAGAGATGGCTGACTGAGGCCAGAAAAGAGACTGTGATGGGGCA
GCCTACTCCGAAGACCCCTCGACAACTAAGGGAGTTCCTAGGGAAGGCAGGCTTC
TGTCGCCTCTTCATCCCTGGGTTTGCAGAAATGGCAGCCCCCCTGTACCCTCTCAC
CAAACCGGGGACTCTGTTTAATTGGGGCCCAGACCAACAAAAGGCCTATCAAGAA
ATCAAGCAAGCTCTTCTAACTGCCCCAGCCCTGGGGTTGCCAGATTTGACTAAGC
CCTTTGAACTCTTTGTCGACGAGAAGCAGGGCTACGCCAAAGGTGTCCTAACGCA
AAAACTGGGACCTTGGCGTCGGCCGGTGGCCTACCTGTCCAAAAAGCTAGACCC
AGTAGCAGCTGGGTGGCCCCCTTGCCTACGGATGGTAGCAGCCATTGCCGTACTG
ACAAAGGATGCAGGCAAGCTAACCATGGGACAGCCACTAGTCATTCTGGCCCCCC
ATGCAGTAGAGGCACTAGTCAAACAACCCCCCGACCGCTGGCTTTCCAACGCCCG
GATGACTCACTATCAGGCCTTGCTTTTGGACACGGACCGGGTCCAGTTCGGACCG
GTGGTAGCCCTGAACCCGGCTACGCTGCTCCCACTGCCTGAGGAAGGGCTGCAAC
ACAACTGCCTTGATATCCTGGCCGAAGCCCACGGAAACCCGACCCGACCTAACGGA
CCAGCCGCTCCCAGACGCCGACCACACCTGGTACACGGATGGAAGCAGTCTCTTA
CAAGAGGGACAGCGTAAGGCGGGAGCTGCGGTGACCACCGAGACCGAGGTAATC
TGGGCTAAAGCCCTGCCAGCCGGGACATCCGCTCAGCGGGCTGAACTGATAGCAC
TCACCCAGGCCCTAAAGATGGCAGAAGGTAAGAAGCTAAATGTTTATACTGATAGC
CGTTATGCTTTTGCTACTGCCCATATCCATGGAGAAATATACAGAAGGCGTGGGTG
GCTCACATCAGAAGGCAAAGAGATCAAAAATAAAGACGAGATCTTGGCCCTACTA
AAAGCCCTCTTTCTGCCCAAAAGACTTAGCATAATCCATTGTCCAGGACATCAAAA
GGGACACAGCGCCGAGGCTAGAGGCAACCGGATGGCTGACCAAGCGGCCCGAAA
GGCAGCCATCACAGAGACTCCAGACACCTCTACCCTCCTCATAGAAAATTCATCAC
CCTCTGGCGGCTCAAAAAGAACCGCCGACGGCAGCGAATTCGAGCCCAAGAAGA
AGAGGAAAGTCTAACCGGTCATCATCACCATCACCATTGAGTTTAAACCCGCTGAT
CAGCCTCGACTGTGCCTTCTAGTTGCCAGCCATCTGTTGTTTGCCCCTCCCCCGTG
CCTTCCTTGACCCTGGAAGGTGCCACTCCCACTGTCCTTTCCTAATAAAATGAGAA
AATTGCATCGCATTGTCTGAGTAGGTGTCATTCTATTCTGGGGGGTGGGGTGGGGC
AGGACAGCAAGGGGGAGGATTGGGAAGACAATAGCAGGCATGCTGGGGATGCGG
```

-continued

```
TGGGCTCTATGGCTTCTGAGGCGGAAAGAACCAGCTGGGGCTCGATACCGTCGAC

CTCTAGCTAGAGCTTGGCGTAATCATGGTCATAGCTGTTTCCTGTGTGAAATTGTTA

TCCGCTCACAATTCCACACAACATACGAGCCGGAAGCATAAAGTGTAAAGCCTAG

GGTGCCTAATGAGTGAGCTAACTCACATTAATTGCGTTGCGCTCACTGCCCGCTTT

CCAGTCGGGAAACCTGTCGTGCCAGCTGCATTAATGAATCGGCCAACGCGCGGGG

AGAGGCGGTTTGCGTATTGGGCGCTCTTCCGCTTCCTCGCTCACTGACTCGCTGCG

CTCGGTCGTTCGGCTGCGGCGAGCGGTATCAGCTCACTCAAAGGCGGTAATACGG

TTATCCACAGAATCAGGGGATAACGCAGGAAAGAACATGTGAGCAAAAGGCCAG

CAAAAGGCCAGGAACCGTAAAAAGGCCGCGTTGCTGGCGTTTTTCCATAGGCTCC

GCCCCCCTGACGAGCATCACAAAAATCGACGCTCAAGTCAGAGGTGGCGAAACC

CGACAGGACTATAAAGATACCAGGCGTTTCCCCCTGGAAGCTCCCTCGTGCGCTCT

CCTGTTCCGACCCTGCCGCTTACCGGATACCTGTCCGCCTTTCTCCCTTCGGGAAG

CGTGGCGCTTTCTCATAGCTCACGCTGTAGGTATCTCAGTTCGGTGTAGGTCGTTC

GCTCCAAGCTGGGCTGTGTGCACGAACCCCCCGTTCAGCCCGACCGCTGCGCCTT

ATCCGGTAACTATCGTCTTGAGTCCAACCCGGTAAGACACGACTTATCGCCACTGG

CAGCAGCCACTGGTAACAGGATTAGCAGAGCGAGGTATGTAGGCGGTGCTACAGA

GTTCTTGAAGTGGTGGCCTAACTACGGCTACACTAGAAGAACAGTATTTGGTATCT

GCGCTCTGCTGAAGCCAGTTACCTTCGGAAAAAGAGTTGGTAGCTCTTGATCCGG

CAAACAAACCACCGCTGGTAGCGGTGGTTTTTTTGTTTGCAAGCAGCAGATTACG

CGCAGAAAAAAAGGATCTCAAGAAGATCCTTTGATCTTTTCTACGGGGTCTGACG

CTCAGTGGAACGAAAACTCACGTTAAGGGATTTTGGTCATGAGATTATCAAAAAG

GATCTTCACCTAGATCCTTTTAAATTAAAAATGAAGTTTTAAATCAATCTAAAGTAT

ATATGAGTAAACTTGGTCTGACAGTTACCAATGCTTAATCAGTGAGGCACCTATCT

CAGCGATCTGTCTATTTCGTTCATCCATAGTTGCCTGACTCCCCGTCGTGTAGATAA

CTACGATACGGGAGGGCTTACCATCTGGCCCCAGTGCTGCAATGATACCGCGAGA

CCCACGCTCACCGGCTCCAGATTTATCAGCAATAAACCAGCCAGCCGGAAGGGCC

GAGCGCAGAAGTGGTCCTGCAACTTTATCCGCCTCCATCCAGTCTATTAATTGTTG

CCGGGAAGCTAGAGTAAGTAGTTCGCCAGTTAATAGTTTGCGCAACGTTGTTGCC

ATTGCTACAGGCATCGTGGTGTCACGCTCGTCGTTTGGTATGGCTTCATTCAGCTC

CGGTTCCCAACGATCAAGGCGAGTTACATGATCCCCCATGTTGTGCAAAAAAGCG

GTTAGCTCCTTCGGTCCTCCGATCGTTGTCAGAAGTAAGTTGGCCGCAGTGTTATC

ACTCATGGTTATGGCAGCACTGCATAATTCTCTTACTGTCATGCCATCCGTAAGATG

CTTTTCTGTGACTGGTGAGTACTCAACCAAGTCATTCTGAGAATAGTGTATGCGGC

GACCGAGTTGCTCTTGCCCGGCGTCAATACGGGATAATACCGCGCCACATAGCAG

AACTTTAAAAGTGCTCATCATTGGAAAACGTTCTTCGGGGCGAAAACTCTCAAGG

ATCTTACCGCTGTTGAGATCCAGTTCGATGTAACCCACTCGTGCACCCAACTGATC

TTCAGCATCTTTTACTTTCACCAGCGTTTCTGGGTGAGCAAAAACAGGAAGGCAA

AATGCCGCAAAAAAGGGAATAAGGGCGACACGGAAATGTTGAATACTCATACTCT

TCCTTTTTCAATATTATTGAAGCATTTATCAGGGTTATTGTCTCATGAGCGGATACAT

ATTTGAATGTATTTAGAAAAATAAACAAATAGGGGTTCCGCGCACATTTCCCCGAA
```

-continued

```
AAGTGCCACCTGACGTCGACGGATCGGGAGATCGATCTCCCGATCCCCTAGGGTC

GACTCTCAGTACAATCTGCTCTGATGCCGCATAGTTAAGCCAGTATCTGCTCCCTG

CTTGTGTGTTGGAGGTCGCTGAGTAGTGCGCGAGCAAAATTTAAGCTACAACAAG

GCAAGGCTTGACCGACAATTGCATGAAGAATCTGCTTAGGGTTAGGCGTTTTGCG

CTGCTTCGCGATGTACGGGCCAGATATACGCGTTGACATTGATTATTGACTAGTTAT

TAATAGTAATCAATTACGGGGTCATTAGTTCATAGCCCATATATGGAGTTCCGCGTTA

CATAACTTACGGTAAATGGCCCGCCTGGCTGACCGCCCAACGACCCCCGCCCATTG

ACGTCAATAATGACGTATGTTCCCATAGTAACGCCAATAGGGACTTTCCATTGACGT

CAATGGGTGGAGTATTTACGGTAAACTGCCCACTTGGCAGTACATCAAGTGTATCA

TATGCCAAGTACGCCCCCTATTGACGTCAATGACGGTAAATGGCCCGCCTGGCATT

ATGCCCAGTACATGACCTTATGGGACTTTCCTACTTGGCAGTACATCTACGTATTAG

TCATCGCTATTACCATGGTGATGCGGTTTTGGCAGTACATCAATGGGCGTGGATAGC

GGTTTGACTCACGGGGATTTCCAAGTCTCCACCCCATTGACGTCAATGGGAGTTTG

TTTTGGCACCAAAATCAACGGGACTTTCCAAAATGTCGTAACAACTCCGCCCCATT

GACGCAAATGGGCGGTAGGCGTGTACGGTGGGAGGTCTATATAAGCAGAGCTGGT

TTAGTGAACCGTCAGATCCGCTAGAGATCCGCGGCCGCTAATACGACTCACTATAG

GGAGAGCCGCCACC
```
*N-terminal NLS + Cas9 H840A*
*Flexible linker*
M-MLV reverse transcriptase + C-terminal NLS
Plasmid backbone (containing CMV promoter and AmpR)

pU6-HEK3_PEgRNA_CTTins:

(SEQ ID NO: 735)
```
GAGGGCCTATTTCCCATGATTCCTTCATATTTGCATATACGATACAAGGCTGTTAGA

GAGATAATTAGAATTAATTTGACTGTAAACACAAAGATATTAGTACAAAATACGTG

ACGTAGAAAGTAATAATTTCTTGGGTAGTTTGCAGTTTTAAAATTATGTTTTAAAAT

GGACTATCATATGCTTACCGTAACTTGAAAGTATTTCGATTTCTTGGCTTTATATATC

TTGTGGAAAGGACGAAACACCGGCCCAGACTGAGCACGTGAGTTTTAGAGCTAGA

AATAGCAAGTTAAAATAAGGCTAGTCCGTTATCAACTTGAAAAAGTGGGACCGAG

TCGGTCCTCTGCCATCAAAGCGTGCTCAGTCTGTTTTTTTAAGCTTGGGCCGCT

CGAGGTACCTCTCTACATATGACATGTGAGCAAAAGGCCAGCAAAAGGCCAGGAA

CCGTAAAAAGGCCGCGTTGCTGGCGTTTTTCCATAGGCTCCGCCCCCCTGACGAG

CATCACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGACCCT

GCCGCTTACCGGATACCTGTCCGCCTTTCTCCCTTCGGGAAGCGTGGCGCTTTCTC

ATAGCTCACGCTGTAGGTATCTCAGTTCGGTGTAGGTCGTTCGCTCCAAGCTGGGC

TGTGTGCACGAACCCCCCGTTCAGCCCGACCGCTGCGCCTTATCCGGTAACTATCG

TCTTGAGTCCAACCCGGTAAGACACGACTTATCGCCACTGGCAGCAGCCACTGGT

AACAGGATTAGCAGAGCGAGGTATGTAGGCGGTGCTACAGAGTTCTTGAAGTGGT

GGCCTAACTACGGCTACACTAGAAGAACAGTATTTGGTATCTGCGCTCTGCTGAAG

CCAGTTACCTTCGGAAAAAGAGTTGGTAGCTCTTGATCCGGCAAACAAACCACCG

CTGGTAGCGGTGGTTTTTTTGTTTGCAAGCAGCAGATTACGCGCAGAAAAAAGG
```

-continued

```
ATCTCAAGAAGATCCTTTGATCTTTTCTACGGGGTCTGACGCTCAGTGGAACGAAA

ACTCACGTTAAGGGATTTTGGTCATGAGATTATCAAAAAGGATCTTCACCTAGATC

CTTTTAAATTAAAAATGAAGTTTTAAATCAATCTAAAGTATATATGAGTAAACTTGG

TCTGACAGTTACCAATGCTTAATCAGTGAGGCACCTATCTCAGCGATCTGTCTATTT

CGTTCATCCATAGTTGCCTGACTCCCCGTCGTGTAGATAACTACGATACGGGAGGG

CTTACCATCTGGCCCCAGTGCTGCAATGATACCGCGAGACCCACGCTCACCGGCTC

CAGATTTATCAGCAATAAACCAGCCAGCCGGAAGGGCCGAGCGCAGAAGTGGTC

CTGCAACTTTATCCGCCTCCATCCAGTCTATTAATTGTTGCCGGGAAGCTAGAGTAA

GTAGTTCGCCAGTTAATAGTTTGCGCAACGTTGTTGCCATTGCTACAGGCATCGTG

GTGTCACGCTCGTCGTTTGGTATGGCTTCATTCAGCTCCGGTTCCCAACGATCAAG

GCGAGTTACATGATCCCCCATGTTGTGCAAAAAAGCGGTTAGCTCCTTCGGTCCTC

CGATCGTTGTCAGAAGTAAGTTGGCCGCAGTGTTATCACTCATGGTTATGGCAGCA

CTGCATAATTCTCTTACTGTCATGCCATCCGTAAGATGCTTTTCTGTGACTGGTGAG

TACTCAACCAAGTCATTCTGAGAATAGTGTATGCGGCGACCGAGTTGCTCTTGCCC

GGCGTCAATACGGGATAATACCGCGCCACATAGCAGAACTTTAAAAGTGCTCATCA

TTGGAAAACGTTCTTCGGGGCGAAAACTCTCAAGGATCTTACCGCTGTTGAGATC

CAGTTCGATGTAACCCACTCGTGCACCCAACTGATCTTCAGCATCTTTTACTTTCA

CCAGCGTTTCTGGGTGAGCAAAAACAGGAAGGCAAAATGCCGCAAAAAAGGGA

ATAAGGGCGACACGGAAATGTTGAATACTCATACTCTTCCTTTTTCAATATTATTGA

AGCATTTATCAGGGTTATTGTCTCATGAGCGGATACATATTTGAATGTATTTAGAAA

AATAAACAAATAGGGGTTCCGCGCACATTTCCCCGAAAAGTGCCACCTGACGTCG

CTAGCTGTACAAAAAAGCAGGCTTTAAAGGAACCAATTCAGTCGACTGGATCCGG

TACCAAGGTCGGGCAGGAA
```
U6 Promoter sequence
*Spacer sequence*
sgRNA scaffold
<u>3' extension (contains PBS and RT template)</u>
Backbone (contains AmpR)

pLenti-hSyn-N-PE2-NpuN-P2A-GFP-KASH_U6-DNMT1-PEgRNA:

```
GTCGACGGATCGGGAGATCTCCCGATCCCCTATGGTGCACTCTCAGTACAATCTGCTCT    (SEQ ID NO: 736)

GATGCCGCATAGTTAAGCCAGTATCTGCTCCCTGCTTGTGTGTTGGAGGTCGCTGAGTA

GTGCGCGAGCAAAATTTAAGCTACAACAAGGCAAGGCTTGACCGACAATTGCATGAAG

AATCTGCTTAGGGTTAGGCGTTTTGCGCTGCTTCGCGATGTACGGGCCAGATATACGCG

TTGACATTGATTATTGACTAGTTATTAATAGTAATCAATTACGGGGTCATTAGTTCATAGC

CCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAG

GGACTTTCCATTGACGTCAATGGGTGGAGTATTTACGGTAAACTGCCCACTTGGCAGTA

CATCAAGTGTATCATATGCCAAGTACGCCCCCTATTGACGTCAATGACGGTAAATGGCC

CGCCTGGCATTATGCCCAGTACATGACCTTATGGGACTTTCCTACTTGGCAGTACATCTA

CGTATTAGTCATCGCTATTACCATGGTGATGCGGTTTTGGCAGTACATCAATGGGCGTGG

ATAGCGGTTTGACTCACGGGGATTTCCAAGTCTCCACCCCATTGACGTCAATGGGAGTT
```

-continued

TGTTTTGGCACCAAAATCAACGGGACTTTCCAAAATGTCGTAACAACTCCGCCCCATTG

ACGCAAATGGGCGGTAGGCGTGTACGGTGGGAGGTCTATATAAGCAGCGCGTTTTGCC

TGTACTGGGTCTCTCTGGTTAGACCAGATCTGAGCCTGGGAGCTCTCTGGCTAACTAGG

GAACCCACTGCTTAAGCCTCAATAAAGCTTGCCTTGAGTGCTTCAAGTAGTGTGTGCCC

GTCTGTTGTGTGACTCTGGTAACTAGAGATCCCTCAGACCCTTTTAGTCAGTGTGGAAA

ATCTCTAGCAGTGGCGCCCGAACAGGGACTTGAAAGCGAAAGGGAAACCAGAGGAGC

TCTCTCGACGCAGGACTCGGCTTGCTGAAGCGCGCACGGCAAGAGGCGAGGGGCGGC

GACTGGTGAGTACGCCAAAAATTTTGACTAGCGGAGGCTAGAAGGAGAGAGATGGGT

GCGAGAGCGTCAGTATTAAGCGGGGGAGAATTAGATCGCGATGGGAAAAAATTCGGTT

AAGGCCAGGGGGAAAGAAAAAATATAAATTAAAACATATAGTATGGGCAAGCAGGGAG

CTAGAACGATTCGCAGTTAATCCTGGCCTGTTAGAAACATCAGAAGGCTGTAGACAAAT

ACTGGGACAGCTACAACCATCCCTTCAGACAGGATCAGAAGAACTTAGATCATTATATA

ATACAGTAGCAACCCTCTATTGTGTGCATCAAAGGATAGAGATAAAAGACACCAAGGA

AGCTTTAGACAAGATAGAGGAAGAGCAAAACAAAGTAAGACCACCGCACAGCAAGC

GGCCGCTGATCTTCAGACCTGGAGGAGGAGATATGAGGGACAATTGGAGAAGTGAATT

ATATAAATATAAAGTAGTAAAAATTGAACCATTAGGAGTAGCACCCACCAAGGCAAAGA

GAAGAGTGGTGCAGAGAGAAAAAAGAGCAGTGGGAATAGGAGCTTTGTTCCTTGGGT

TCTTGGGAGCAGCAGGAAGCACTATGGGCGCAGCGTCAATGACGCTGACGGTACAGG

CCAGACAATTATTGTCTGGTATAGTGCAGCAGCAGAACAATTTGCTGAGGGCTATTGAG

GCGCAACAGCATCTGTTGCAACTCACAGTCTGGGGCATCAAGCAGCTCCAGGCAAGA

ATCCTGGCTGTGGAAAGATACCTAAAGGATCAACAGCTCCTGGGGATTTGGGGTTGCT

CTGGAAAACTCATTTGCACCACTGCTGTGCCTTGGAATGCTAGTTGGAGTAATAAATCT

CTGGAACAGATTTGGAATCACACGACCTGGATGGAGTGGGACAGAGAAATTAACAATT

ACACAAGCTTAATACACTCCTTAATTGAAGAATCGCAAACCAGCAAGAAAAGAATGA

ACAAGAATTATTGGAATTAGATAAATGGGCAAGTTTGTGGAATTGGTTTAACATAACAA

ATTGGCTGTGGTATATAAAATTATTCATAATGATAGTAGGAGGCTTGGTAGGTTTAAGAA

TAGTTTTTGCTGTACTTTCTATAGTGAATAGAGTTAGGCAGGGATATTCACCATTATCGTT

TCAGACCCACCTCCCAACCCCGAGGGGACCCGACAGGCCCGAAGGAATAGAAGAAGA

AGGTGGAGAGAGAGACAGAGACAGATCCATTCGATTAGTGAACGGATCGGCACTGCG

TGCGCCAATTCTGCAGACAAATGGCAGTATTCATCCACAATTTTAAAAGAAAAGGGGG

GATTGGGGGGTACAGTGCAGGGGAAAGAATAGTAGACATAATAGCAACAGACATACAA

ACTAAAGAATTACAAAAACAAATTACAAAAATTCAAAATTTTCGGGTTTATTACAGGGA

CAGCAGAGATCCAGTTTGGTTAATTAAGGTACCAAGGTCGGGCAGGAA<u>GAGGGCCTAT</u>

<u>TTCCCATGATTCCTTCATATTTGCATATACGATACAAGGCTGTTAGAGAGATAATTAGAAT</u>

<u>TAATTTGACTGTAAACACAAAGATATTAGTACAAAATACGTGACGTAGAAAGTAATAAT</u>

<u>TTCTTGGGTAGTTTGCAGTTTTAAAATTATGTTTTAAAATGGACTATCATATGCTTACCGT</u>

<u>AACTTGAAAGTATTTCGATTTCTTGGCTTTATATATCTTGTGGAAAGGACGAAACACC</u>G

CGGGCTGGAGCTGTTCGCGCGTTTTAGAGCTAGAAATAGCAAGTTAAAATAAGGC

TAGTCCGTTATCAACTTGAAAAAGTGGCACCGAGTCGGTGCAAGATGCAAGCGC

GAACAGCTCCAG<u>TTTTTTTGAATTC</u>*AGTGCAAGTGGGTTTAGGACCAGGATGAGGCG*

-continued

*GGGTGGGGGTGCCTACCTGACGACCGACCCCGACCCACTGGACAAGCACCCAACCCCCAT*

*TCCCCAAATTGCGCATCCCCTATCAGAGAGGGGGAGGGGAAACAGGATGCGGCGAGGCGC*

*GTGCGCACTGCCAGCTTCAGCACCGCGGACAGTGCCTTCGCCCCCGCCTGGCGGCGCGC*

*GCCACCGCCGCCTCAGCACTGAAGGCGCGCTGACGTCACTCGCCGGTCCCCCGCAAACTC*

*CCCTTCCCGGCCACCTTGGTCGCGTCCGCGCCGCCGCCGGCCCAGCCGGACCGCACCAC*

*GCGAGGCGCGAGATAGGGGGGCACGGGCGCGACCATCTGCGCTGCGGCGCCGGCGACT*

*CAGCGCTGCCTCAGTCTGCGGTGGGCAGCGGAGGAGTCGTGTCGTGCCTGAGAGCGCAG*

_TCGAGAATCTAGAGCGCTGCCACC_ATGAAACGGACAGCCGACGGAAGCGAGTTCGAGT

CACCAAAGAAGAAGCGGAAAGTCGACAAGAAGTACAGCATCGGCCTGGACATCGGCA

CCAACTCTGTGGGCTGGGCCGTGATCACCGACGAGTACAAGGTGCCCAGCAAGAAATT

CAAGGTGCTGGGCAACACCGACCGGCACAGCATCAAGAAGAACCTGATCGGAGCCCT

GCTGTTCGACAGCGGCGAAACAGCCGAGGCCACCCGGCTGAAGAGAACCGCCAGAA

GAAGATACACCAGACGGAAGAACCGGATCTGCTATCTGCAAGAGATCTTCAGCAACGA

GATGGCCAAGGTGGACGACAGCTTCTTCCACAGACTGGAAGAGTCCTTCCTGGTGGA

AGAGGATAAGAAGCACGAGCGGCACCCCATCTTCGGCAACATCGTGGACGAGGTGGC

CTACCACGAGAAGTACCCCACCATCTACCACCTGAGAAAGAAACTGGTGGACAGCAC

CGACAAGGCCGACCTGCGGCTGATCTATCTGGCCCTGGCCCACATGATCAAGTTCCGG

GGCCACTTCCTGATCGAGGGCGACCTGAACCCCGACAACAGCGACGTGGACAAGCTG

TTCATCCAGCTGGTGCAGACCTACAACCAGCTGTTCGAGGAAAACCCCATCAACGCCA

GCGGCGTGGACGCCAAGGCCATCCTGTCTGCCAGACTGAGCAAGAGCAGACGGCTGG

AAAATCTGATCGCCCAGCTGCCCGGCGAGAAGAAGAATGGCCTGTTCGGAAACCTGAT

TGCCCTGAGCCTGGGCCTGACCCCCAACTTCAAGAGCAACTTCGACCTGGCCGAGGAT

GCCAAACTGCAGCTGAGCAAGGACACCTACGACGACGACCTGGACAACCTGCTGGCC

CAGATCGGCGACCAGTACGCCGACCTGTTTCTGGCCGCCAAGAACCTGTCCGACGCCA

TCCTGCTGAGCGACATCCTGAGAGTGAACACCGAGATCACCAAGGCCCCCCTGAGCGC

CTCTATGATCAAGAGATACGACGAGCACCACCAGGACCTGACCCTGCTGAAAGCTCTC

GTGCGGCAGCAGCTGCCTGAGAAGTACAAAGAGATTTTCTTCGACCAGAGCAAGAAC

GGCTACGCCGGCTACATTGACGGCGGAGCCAGCCAGGAAGAGTTCTACAAGTTCATCA

AGCCCATCCTGGAAAAGATGGACGGCACCGAGGAACTGCTCGTGAAGCTGAACAGAG

AGGACCTGCTGCGGAAGCAGCGGACCTTCGACAACGGCAGCATCCCCCACCAGATCC

ACCTGGGAGAGCTGCACGCCATTCTGCGGCGGCAGGAAGATTTTTACCCATTCCTGAA

GGACAACCGGGAAAAGATCGAGAAGATCCTGACCTTCCGCATCCCCTACTACGTGGGC

CCTCTGGCCAGGGGAAACAGCAGATTCGCCTGGATGACCAGAAAGAGCGAGGAAACC

ATCACCCCCTGGAACTTCGAGGAAGTGGTGGACAAGGGCGCTTCCGCCCAGAGCTTC

ATCGAGCGGATGACCAACTTCGATAAGAACCTGCCCAACGAGAAGGTGCTGCCCAAGC

ACAGCCTGCTGTACGAGTACTTCACCGTGTATAACGAGCTGACCAAAGTGAAATACGT

GACCGAGGGAATGAGAAAGCCCGCCTTCCTGAGCGGCGAGCAGAAAAAGGCCATCGT

GGACCTGCTGTTCAAGACCAACCGGAAAGTGACCGTGAAGCAGCTGAAAGAGGACTA

CTTCAAGAAAATCGAG*TGCCTGTCCTACGAGACAGAGATCCTGACAGTGGAGTATGGCCT*

GCTGCCAATCGGCAAGATCGTGGAGAAGAGGATCGAGTGTACCGTGTACTCTGTGGATAAC

AATGGCAACATCTATACACAGCCCGTGGCACAGTGGCACGATAGGGGAGAGCAGGAGGTGT

```
TCGAGTATTGCCTGGAGGACGGCAGCCTGATCAGGGCAACCAAGGACCACAAGTTCATGAC

AGTGGATGGCCAGATGCTGCCCATCGACGAGAI7TTCGAGCGGGAGCTGGACCTGATGAGA

GTGGATAACCTGCCTAATAGCGGAGGCAGTAAAAGAACAGCAGACGGGAGTGAGTTTGA

GCCCAAGAAAAAGAGAAAGGTGGGATCCGGCGCAACAACTTCTCTCTGCTGAAACAA

GCCGGAGATGTCGAAGAGAATCCTGGACCGGTGAGCAAGGGCGAGGAGCTGTTCACCG

GGGTGGTGCCCATCCTGGTCGAGCTGGACGGCGACGTAAACGGCCACAAGTTCAGCGT

GTCCGGCGAGGGCGAGGGCGATGCCACCTACGGCAAGCTGACCCTGAAGTTCATCTGC

ACCACCGGCAAGCTGCCCGTGCCCTGGCCCACCCTCGTGACCACCCTGACCTACGGCCT

GCAGTGCTTCAGCCGCTACCCCGACCACATGAAGCAGCACGACTTCTTCAAGTCCGCCA

TGCCCGAAGGCTACGTCCAGGAGCGCACCATCTTCTTCAAGGACGACGGCAACTACAAG

ACCCGCGCCGAGGTGAAGTTCGAGGGCGACACCCTGGTGAACCGCATCGAGCTGAAGG

GCATCGACTTCAAGGAGGACGGCAACATCCTGGGGCACAAGCTGGAGTACAACTACAAC

AGCCACAACGTCTATATCATGGCCGACAAGCAGAAGAACGGCATCAAGGTGAACTTCAA

GATCCGCCACAACATCGAGGACGGCAGCGTGCAGCTCGCCGACCACTACCAGCAGAAC

ACCCCCATCGGCGACGGCCCCGTGCTGCTGCCCGACAACCACTACCTGAGCACCCAGTC

CGCCCTGAGCAAAGACCCCAACGAGAAGCGCGATCACATGGTCCTGCTGGAGTTCGTG

ACCGCCGCCGGGATCACTCTCGGCATGGACGAGCTGTACAAGTCCGGACTCAGATCTCG

AGAGGAGGAGGAGGAGACAGACAGCAGGATGCCCCACCTCGACAGCCCCGGCAGCTCC

CAGCCGAGACGCTCCTTCCTCTCAAGGGTGATCAGGGCAGCGCTACCGTTGCAGCTGCT

TCTGCTGCTGCTGCTGCTCCTGGCCTGCCTGCTACCTGCCTCTGAAGATGACTACAGCT

GCACCCAGGCCAACAACTTTGCCCGATCCTTCTACCCCATGCTGCGGTACACCAACGGG

CCACCTCCCACCTAAACGCGTTAAGTCGACAATCAACCTCTGGATTACAAAATTTGTGA

AAGATTGACTGGTATTCTTAACTATGTTGCTCCTTTTACGCTATGTGGATACGCTGCTTTA

ATGCCTTTGTATCATGCTATTGCTTCCCGTATGGCTTTCATTTTCTCCTCCTTGTATAAATC

CTGGTTGCTGTCTCTTTATGAGGAGTTGTGGCCCGTTGTCAGGCAACGTGGCGTGGTGT

GCACTGTGTTTGCTGACGCAACCCCCACTGGTTGGGGCATTGCCACCACCTGTCAGCT

CCTTTCCGGGACTTTCGCTTTCCCCCTCCCTATTGCCACGGCGGAACTCATCGCCGCCT

GCCTTGCCCGCTGCTGGACAGGGGCTCGGCTGTTGGGCACTGACAATTCCGTGGTGTT

GTCGGGGAAATCATCGTCCTTTCCTTGGCTGCTCGCCTGTGTTGCCACCTGGATTCTGC

GCGGGACGTCCTTCTGCTACGTCCCTTCGGCCCTCAATCCAGCGGACCTTCCTTCCCGC

GGCCTGCTGCCGGCTCTGCGGCCTCTTCCGCGTCTTCGCCTTCGCCCTCAGACGAGTC

GGATCTCCCTTTGGGCCGCCTCCCCGCGTCGACTTTAAGACCAATGACTTACAAGGCA

GCTGTAGATCTTAGCCACTTTTTAAAAGAAAAGGGGGGACTGGAAGGGCTAATTCACT

CCCAACGAAGACAAGATCTGCTTTTTGCTTGTACTGGGTCTCTCTGGTTAGACCAGATC

TGAGCCTGGGAGCTCTCTGGCTAACTAGGGAACCCACTGCTTAAGCCTCAATAAAGCT

TGCCTTGAGTGCTTCAAGTAGTGTGTGCCCGTCTGTTGTGTGACTCTGGTAACTAGAGA

TCCCTCAGACCCTTTTAGTCAGTGTGGAAAATCTCTAGCAGGGCCCGTTTAAACCCGCT

GATCAGCCTCGACTGTGCCTTCTAGTTGCCAGCCATCTGTTGTTTGCCCCTCCCCCGTG

CCTTCCTTGACCCTGGAAGGTGCCACTCCCACTGTCCTTTCCTAATAAAATGAGGAAAT

TGCATCGCATTGTCTGAGTAGGTGTCATTCTATTCTGGGGGGTGGGGTGGGGCAGGACA
```

-continued

```
GCAAGGGGGAGGATTGGGAAGACAATAGCAGGCATGCTGGGGATGCGGTGGGCTCTAT
GGCTTCTGAGGCGGAAAGAACCAGCTGGGGCTCTAGGGGGTATCCCCACGCGCCCTGT
AGCGGCGCATTAAGCGCGGCGGGTGTGGTGGTTACGCGCAGCGTGACCGCTACACTTG
CCAGCGCCCTAGCGCCCGCTCCTTTCGCTTTCTTCCCTTCCTTTCTCGCCACGTTCGCC
GGCTTTCCCCGTCAAGCTCTAAATCGGGGGCTCCCTTTAGGGTTCCGATTTAGTGCTTT
ACGGCACCTCGACCCCAAAAAACTTGATTAGGGTGATGGTTCACGTAGTGGGCCATCG
CCCTGATAGACGGTTTTTCGCCCTTTGACGTTGGAGTCCACGTTCTTTAATAGTGGACT
CTTGTTCCAAACTGGAACAACACTCAACCCTATCTCGGTCTATTCTTTTGATTTATAAGG
GATTTTGCCGATTTCGGCCTATTGGTTAAAAAATGAGCTGATTTAACAAAAATTTAACGC
GAATTAATTCTGTGGAATGTGTGTCAGTTAGGGTGTGGAAAGTCCCCAGGCTCCCCAG
CAGGCAGAAGTATGCAAAGCATGCATCTCAATTAGTCAGCAACCAGGTGTGGAAAGTC
CCCAGGCTCCCCAGCAGGCAGAAGTATGCAAAGCATGCATCTCAATTAGTCAGCAACC
ATAGTCCCGCCCCTAACTCCGCCCATCCCGCCCCTAACTCCGCCCAGTTCCGCCCATTC
TCCGCCCCATGGCTGACTAATTTTTTTTATTTATGCAGAGGCCGAGGCCGCCTCTGCCTC
TGAGCTATTCCAGAAGTAGTGAGGAGGCTTTTTTGGAGGCCTAGGCTTTTGCAAAAAG
CTCCCGGGAGCTTGTATATCCATTTTCGGATCTGATCAGCACGTGTTGACAATTAATCAT
CGGCATAGTATATCGGCATAGTATAATACGACAAGGTGAGGAACTAAACCATGGCCAAG
TTGACCAGTGCCGTTCCGGTGCTCACCGCGCGCGACGTCGCCGGAGCGGTCGAGTTCT
GGACCGACCGGCTCGGGTTCTCCCGGGACTTCGTGGAGGACGACTTCGCCGGTGTGGT
CCGGGACGACGTGACCCTGTTCATCAGCGCGGTCCAGGACCAGGTGGTGCCGGACAA
CACCCTGGCCTGGGTGTGGGTGCGCGGCCTGGACGAGCTGTACGCCGAGTGGTCGGA
GGTCGTGTCCACGAACTTCCGGGACGCCTCCGGGCCGGCCATGACCGAGATCGGCGA
GCAGCCGTGGGGCGGGAGTTCGCCCTGCGCGACCCGGCCGGCAACTGCGTGCACTT
CGTGGCCGAGGAGCAGGACTGACACGTGCTACGAGATTTCGATTCCACCGCCGCCTTC
TATGAAAGGTTGGGCTTCGGAATCGTTTTCCGGGACGCCGGCTGGATGATCCTCCAGCG
CGGGGATCTCATGCTGGAGTTCTTCGCCCACCCCAACTTGTTTATTGCAGCTTATAATGG
TTACAAATAAAGCAATAGCATCACAAATTTCACAAATAAAGCATTTTTTTCACTGCATTC
TAGTTGTGGTTTGTCCAAACTCATCAATGTATCTTATCATGTCTGTATACCGTCGACCTCT
AGCTAGAGCTTGGCGTAATCATGGTCATAGCTGTTTCCTGTGTGAAATTGTTATCCGCTC
ACAATTCCACACAACATACGAGCCGGAAGCATAAAGTGTAAAGCCTGGGGTGCCTAAT
GAGTGAGCTAACTCACATTAATTGCGTTGCGCTCACTGCCCGCTTTCCAGTCGGGAAAC
CTGTCGTGCCAGCTGCATTAATGAATCGGCCAACGCGCGGGGAGAGGCGGTTTGCGTA
TTGGGCGCTCTTCCGCTTCCTCGCTCACTGACTCGCTGCGCTCGGTCGTTCGGCTGCGG
CGAGCGGTATCAGCTCACTCAAAGGCGGTAATACGGTTATCCACAGAATCAGGGGATA
ACGCAGGAAAGAACATGTGAGCAAAAGGCCAGCAAAAGGCCAGGAACCGTAAAAAG
GCCGCGTTGCTGGCGTTTTTCCATAGGCTCCGCCCCCCTGACGAGCATCACAAAAATCG
ACGCTCAAGTCAGAGGTGGCGAAACCCGACAGGACTATAAAGATACCAGGCGTTTCCC
CCTGGAAGCTCCCTCGTGCGCTCTCCTGTTCCGACCCTGCCGCTTACCGGATACCTGTC
CGCCTTTCTCCCTTCGGGAAGCGTGGCGCTTTCTCATAGCTCACGCTGTAGGTATCTCA
GTTCGGTGTAGGTCGTTCGCTCCAAGCTGGGCTGTGTGCACGAACCCCCCGTTCAGCC
CGACCGCTGCGCCTTATCCGGTAACTATCGTCTTGAGTCCAACCCGGTAAGACACGACT
```

-continued

```
TATCGCCACTGGCAGCAGCCACTGGTAACAGGATTAGCAGAGCGAGGTATGTAGGCGG

TGCTACAGAGTTCTTGAAGTGGTGGCCTAACTACGGCTACACTAGAAGAACAGTATTTG

GTATCTGCGCTCTGCTGAAGCCAGTTACCTTCGGAAAAAGAGTTGGTAGCTCTTGATCC

GGCAAACAAACCACCGCTGGTAGCGGTGGTTTTTTTGTTTGCAAGCAGCAGATTACGC

GCAGAAAAAAAGGATCTCAAGAAGATCCTTTGATCTTTTCTACGGGGTCTGACGCTCA

GTGGAACGAAAACTCACGTTAAGGGATTTTGGTCATGAGATTATCAAAAGGATCTTC

ACCTAGATCCTTTTAAATTAAAAATGAAGTTTTAAATCAATCTAAAGTATATATGAGTAA

ACTTGGTCTGACAGTTACCAATGCTTAATCAGTGAGGCACCTATCTCAGCGATCTGTCT

ATTTCGTTCATCCATAGTTGCCTGACTCCCCGTCGTGTAGATAACTACGATACGGGAGG

GCTTACCATCTGGCCCCAGTGCTGCAATGATACCGCGAGACCCACGCTCACCGGCTCC

AGATTTATCAGCAATAAACCAGCCAGCCGGAAGGGCCGAGCGCAGAAGTGGTCCTGC

AACTTTATCCGCCTCCATCCAGTCTATTAATTGTTGCCGGGAAGCTAGAGTAAGTAGTTC

GCCAGTTAATAGTTTGCGCAACGTTGTTGCCATTGCTACAGGCATCGTGGTGTCACGCT

CGTCGTTTGGTATGGCTTCATTCAGCTCCGGTTCCCAACGATCAAGGCGAGTTACATGA

TCCCCCATGTTGTGCAAAAAAGCGGTTAGCTCCTTCGGTCCTCCGATCGTTGTCAGAAG

TAAGTTGGCCGCAGTGTTATCACTCATGGTTATGGCAGCACTGCATAATTCTCTTACTGT

CATGCCATCCGTAAGATGCTTTTCTGTGACTGGTGAGTACTCAACCAAGTCATTCTGAG

AATAGTGTATGCGGCGACCGAGTTGCTCTTGCCCGGCGTCAATACGGGATAATACCGCG

CCACATAGCAGAACTTTAAAAGTGCTCATCATTGGAAAACGTTCTTCGGGGCGAAAAC

TCTCAAGGATCTTACCGCTGTTGAGATCCAGTTCGATGTAACCCACTCGTGCACCCAAC

TGATCTTCAGCATCTTTTACTTTCACCAGCGTTTCTGGGTGAGCAAAAACAGGAAGGC

AAAATGCCGCAAAAAAGGGAATAAGGGCGACACGGAAATGTTGAATACTCATACTCTT

CCTTTTTCAATATTATTGAAGCATTTATCAGGGTTATTGTCTCATGAGCGGATACATATTT

GAATGTATTTAGAAAAATAAACAAATAGGGGTTCCGCGCACATTTCCCCGAAAAGT

GCCACCTGAC
```

U6promoter
PEgRNA
*hSynpromoter*
N-tcrmPE2
N-termNpu
P2A-GFP-KASH pLenti-hSyn-C-PE2-NpuC:

```
GTCGACGGATCGGGAGATCTCCCGATCCCCTATGGTGCACTCTCAGTACAATCTGCTCT    (SEQ ID NO: 737)

GATGCCGCATAGTTAAGCCAGTATCTGCTCCCTGCTTGTGTGTTGGAGGTCGCTGAGTA

GTGCGCGAGCAAAATTTAAGCTACAACAAGGCAAGGCTTGACCGACAATTGCATGAAG

AATCTGCTTAGGGTTAGGCGTTTTGCGCTGCTTCGCGATGTACGGGCCAGATATACGCG

TTGACATTGATTATTGACTAGTTATTAATAGTAATCAATTACGGGGTCATTAGTTCATAGC

CCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAG

GGACTTTCCATTGACGTCAATGGGTGGAGTATTTACGGTAAACTGCCCACTTGGCAGTA

CATCAAGTGTATCATATGCCAAGTACGCCCCCTATTGACGTCAATGACGGTAAATGGCC

CGCCTGGCATTATGCCCAGTACATGACCTTATGGGACTTTCCTACTTGGCAGTACATCTA
```

-continued

```
CGTATTAGTCATCGCTATTACCATGGTGATGCGGTTTTGGCAGTACATCAATGGGCGTGG

ATAGCGGTTTGACTCACGGGGATTTCCAAGTCTCCACCCCATTGACGTCAATGGGAGTT

TGTTTTGGCACCAAAATCAACGGGACTTTCCAAAATGTCGTAACAACTCCGCCCCATTG

ACGCAAATGGGCGGTAGGCGTGTACGGTGGGAGGTCTATATAAGCAGCGCGTTTTGCC

TGTACTGGGTCTCTCTGGTTAGACCAGATCTGAGCCTGGGAGCTCTCTGGCTAACTAGG

GAACCCACTGCTTAAGCCTCAATAAAGCTTGCCTTGAGTGCTTCAAGTAGTGTGTGCCC

GTCTGTTGTGTGACTCTGGTAACTAGAGATCCCTCAGACCCTTTTAGTCAGTGTGGAAA

ATCTCTAGCAGTGGCGCCCGAACAGGGACTTGAAAGCGAAAGGGAAACCAGAGGAGC

TCTCTCGACGCAGGACTCGGCTTGCTGAAGCGCGCACGGCAAGAGGCGAGGGGCGGC

GACTGGTGAGTACGCCAAAAATTTTGACTAGCGGAGGCTAGAAGGAGAGAGATGGGT

GCGAGAGCGTCAGTATTAAGCGGGGGAGAATTAGATCGCGATGGGAAAAAATTCGGTT

AAGGCCAGGGGGAAAGAAAAAATATAAATTAAAACATATAGTATGGGCAAGCAGGGAG

CTAGAACGATTCGCAGTTAATCCTGGCCTGTTAGAAACATCAGAAGGCTGTAGACAAAT

ACTGGGACAGCTACAACCATCCCTTCAGACAGGATCAGAAGAACTTAGATCATTATATA

ATACAGTAGCAACCCTCTATTGTGTGCATCAAAGGATAGAGATAAAAGACACCAAGGA

AGCTTTAGACAAGATAGAGGAAGAGCAAAACAAAAGTAAGACCACCGCACAGCAAGC

GGCCGCTGATCTTCAGACCTGGAGGAGGAGATATGAGGGACAATTGGAGAAGTGAATT

ATATAAATATAAAGTAGTAAAAATTGAACCATTAGGAGTAGCACCCACCAAGGCAAAGA

GAAGAGTGGTGCAGAGAGAAAAAAGAGCAGTGGGAATAGGAGCTTTGTTCCTTGGGT

TCTTGGGAGCAGCAGGAAGCACTATGGGCGCAGCGTCAATGACGCTGACGGTACAGG

CCAGACAATTATTGTCTGGTATAGTGCAGCAGCAGAACAATTTGCTGAGGGCTATTGAG

GCGCAACAGCATCTGTTGCAACTCACAGTCTGGGGCATCAAGCAGCTCCAGGCAAGA

ATCCTGGCTGTGGAAAGATACCTAAAGGATCAACAGCTCCTGGGGATTTGGGGTTGCT

CTGGAAAACTCATTTGCACCACTGCTGTGCCTTGGAATGCTAGTTGGAGTAATAAATCT

CTGGAACAGATTTGGAATCACACGACCTGGATGGAGTGGGACAGAGAAATTAACAATT

ACACAAGCTTAATACACTCCTTAATTGAAGAATCGCAAACCAGCAAGAAAAGAATGA

ACAAGAATTATTGGAATTAGATAAATGGGCAAGTTTGTGGAATTGGTTTAACATAACAA

ATTGGCTGTGGTATATAAAATTATTCATAATGATAGTAGGAGGCTTGGTAGGTTTAAGAA

TAGTTTTTGCTGTACTTTCTATAGTGAATAGAGTTAGGCAGGGATATTCACCATTATCGTT

TCAGACCCACCTCCCAACCCCGAGGGGACCCGACAGGCCCGAAGGAATAGAAGAAGA

AGGTGGAGAGAGAGACAGAGACAGATCCATTCGATTAGTGAACGGATCGGCACTGCG

TGCGCCAATTCTGCAGACAAATGGCAGTATTCATCCACAATTTTAAAAGAAAAGGGGG

GATTGGGGGGTACAGTGCAGGGGAAAGAATAGTAGACATAATAGCAACAGACATACAA

ACTAAAGAATTACAAAAACAAATTACAAAAATTCAAAATTTTCGGGTTTATTACAGGGA

CAGCAGAGATCCAGTTTGGTTAATTAAGGTACCAGTGCAAGTGGGTTTTAGGACCAGG

ATGAGGCGGGTGGGGTGCCTACCTGACGACCGACCCCGACCCACTGGACAAGCAC

CCAACCCCCATTCCCCAAATTGCGCATCCCCTATCAGAGAGGGGAGGGGAAACAGGA

TGCGGCGAGGCGCGTGCGCACTGCCAGCTTCAGCACCGCGGACAGTGCCTTCGCCCC

CGCCTGGCGGCGCGCGCCACCGCCGCCTCAGCACTGAAGGCGCGCTGACGTCACTCG

CCGGTCCCCCGCAAACTCCCCTTCCCGGCCACCTTGGTCGCGTCCGCGCCGCCGCCGG
```

-continued

CCCAGCCGGACCGCACCACGCGAGGCGCGAGATAGGGGGGCACGGGCGCGACCATCT

GCGCTGCGGCGCCGGCGACTCAGCGCTGCCTCAGTCTGCGGTGGGCAGCGGAGGAGT

CGTGTCGTGCCTGAGAGCGCAGTCGAGAATCTAGAGCGCTGCCACCATGAAACGGACAGC

CGACGGAAGCGAGTTCGAGTCACCAAAGAAGAAGCGGAAAGTCATCAAGATTGCTACACGG

AAATACCTGGGAAAGCAGAACGTGTACGACATCGGCGTGGAGCGGGATCACAACTTCGCCC

TGAAGAATGGCTTTATCGCCAGCAATTGCTTCGACTCCGTGGAAATCTCCGGCGTGGA

AGATCGGTTCAACGCCTCCCTGGGCACATACCACGATCTGCTGAAAATTATCAAG

GACAAGGACTTCCTGGACAATGAGGAAAACGAGGACATTCTGGAAGATATCGTG

CTGACCCTGACACTGTTTGAGGACAGAGAGATGATCGAGGAACGGCTGAAAACC

TATGCCCACCTGTTCGACGACAAAGTGATGAAGCAGCTGAAGCGGCGGAGATAC

ACCGGCTGGGGCAGGCTGAGCCGGAAGCTGATCAACGGCATCCGGGACAAGCA

GTCCGGCAAGACAATCCTGGATTTCCTGAAGTCCGACGGCTTCGCCAACAGAAA

CTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCC

GGCAGCCCCGCCATTAAGAAGGGCATCCTGCAGACAGTGAAGGTGGTGGACGAG

CTCGTGAAAGTGATGGGCCGGCACAAGCCCGAGAACATCGTGATCGAAATGGCC

AGAGAGAACCAGACCACCCAGAAGGGACAGAAGAACAGCCGCGAGAGAATGAA

GCGGATCGAAGAGGGCATCAAAGAGCTGGGCAGCCAGATCCTGAAAGAACACCC

CGTGGAAAACACCCAGCTGCAGAACGAGAAGCTGTACCTGTACTACCTGCAGAA

TGGGCGGGATATGTACGTGGACCAGGAACTGGACATCAACCGGCTGTCCGACTA

CGATGTGGACCATATCGTGCCTCAGAGCTTTCTGAAGGACGACTCCATCGACAAC

AAGGTGCTGACCAGAAGCGACAAGAACCGGGGCAAGAGCGACAACGTGCCCTC

CGAAGAGGTCGTGAAGAAGATGAAGAACTACTGGCGGCAGCTGCTGAACGCCAA

GCTGATTACCCAGAGAAAGTTCGACAATCTGACCAAGGCCGAGAGAGGCGGCCT

GAGCGAACTGGATAAGGCCGGCTTCATCAAGAGACAGCTGGTGGAAACCCGGCA

GATCACAAAGCACGTGGCACAGATCCTGGACTCCCGGATGAACACTAAGTACGA

CGAGAATGACAAGCTGATCCGGGAAGTGAAAGTGATCACCCTGAAGTCCAAGCT

GGTGTCCGATTTCCGGAAGGATTTCCAGTTTTACAAAGTGCGCGAGATCAACAAC

TACCACCACGCCCACGACGCCTACCTGAACGCCGTCGTGGGAACCGCCCTGATC

AAAAAGTACCCTAAGCTGGAAAGCGAGTTCGTGTACGGCGACTACAAGGTGTAC

GACGTGCGGAAGATGATCGCCAAGAGCGAGCAGGAAATCGGCAAGGCTACCGCC

AAGTACTTCTTCTACAGCAACATCATGAACTTTTTCAAGACCGAGATTACCCTGGC

CAACGGCGAGATCCGGAAGCGGCCTCTGATCGAGACAAACGGCGAAACCGGGG

AGATCGTGTGGGATAAGGGCCGGGATTTTGCCACCGTGCGGAAAGTGCTGAGCA

TGCCCCAAGTGAATATCGTGAAAAAGACCGAGGTGCAGACAGGCGGCTTCAGCA

AAGAGTCTATCCTGCCCAAGAGGAACAGCGATAAGCTGATCGCCAGAAAGAAGG

ACTGGGACCCTAAGAAGTACGGCGGCTTCGACAGCCCCACCGTGGCCTATTCTG

TGCTGGTGGTGGCCAAAGTGGAAAAGGGCAAGTCCAAGAAACTGAAGAGTGTG

AAAGAGCTGCTGGGGATCACCATCATGGAAAGAAGCAGCTTCGAGAAGAATCCC

ATCGACTTTCTGGAAGCCAAGGGCTACAAAGAAGTGAAAAAGGACCTGATCATCA

AGCTGCCTAAGTACTCCCTGTTCGAGCTGGAAAACGGCCGGAAGAGAATGCTGG

-continued

<u>CCTCTGCCGGCGAACTGCAGAAGGGAAACGAACTGGCCCTGCCCTCCAAATATG</u>

<u>TGAACTTCCTGTACCTGGCCAGCCACTATGAGAAGCTGAAGGGCTCCCCCGAGG</u>

<u>ATAATGAGCAGAAACAGCTGTTTGTGGAACAGCACAAGCACTACCTGGACGAGAT</u>

<u>CATCGAGCAGATCAGCGAGTTCTCCAAGAGAGTGATCCTGGCCGACGCTAATCTG</u>

<u>GACAAAGTGCTGTCCGCCTACAACAAGCACCGGGATAAGCCCATCAGAGAGCAG</u>

<u>GCCGAGAATATCATCCACCTGTTTACCCTGACCAATCTGGGAGCCCCTGCCGCCT</u>

<u>TCAAGTACTTTGACACCACCATCGACCGGAAGAGGTACACCAGCACCAAAGAGG</u>

<u>TGCTGGACGCCACCCTGATCCACCAGAGCATCACCGGCCTGTACGAGACACGGA</u>

<u>TCGACCTGTCTCAGCTGGGAGGTGACTCTGGCGGCTCAAAAAGAACCGCCGACG</u>

<u>GCAGCGAATTCGAGCCCAAGAAGAAGAGGAAAGTCTAA</u>ACGCGTTAAGTCGACAA

TCAACCTCTGGATTACAAAATTTGTGAAAGATTGACTGGTATTCTTAACTATGTTGCTCC

TTTTACGCTATGTGGATACGCTGCTTTAATGCCTTTGTATCATGCTATTGCTTCCCGTATG

GCTTTCATTTTCTCCTCCTTGTATAAATCCTGGTTGCTGTCTCTTTATGAGGAGTTGTGG

CCCGTTGTCAGGCAACGTGGCGTGGTGTGCACTGTGTTTGCTGACGCAACCCCCACTG

GTTGGGGCATTGCCACCACCTGTCAGCTCCTTTCCGGGACTTTCGCTTTCCCCCTCCCT

ATTGCCACGGCGGAACTCATCGCCGCCTGCCTTGCCCGCTGCTGGACAGGGGCTCGGC

TGTTGGGCACTGACAATTCCGTGGTGTTGTCGGGGAAATCATCGTCCTTTCCTTGGCTG

CTCGCCTGTGTTGCCACCTGGATTCTGCGCGGGACGTCCTTCTGCTACGTCCCTTCGGC

CCTCAATCCAGCGGACCTTCCTTCCCGCGGCCTGCTGCCGGCTCTGCGGCCTCTTCCGC

GTCTTCGCCTTCGCCCTCAGACGAGTCGGATCTCCCTTTGGGCCGCCTCCCCGCGTCGA

CTTTAAGACCAATGACTTACAAGGCAGCTGTAGATCTTAGCCACTTTTTAAAAGAAAAG

GGGGGACTGGAAGGGCTAATTCACTCCCAACGAAGACAAGATCTGCTTTTTGCTTGTA

CTGGGTCTCTCTGGTTAGACCAGATCTGAGCCTGGGAGCTCTCTGGCTAACTAGGGAA

CCCACTGCTTAAGCCTCAATAAAGCTTGCCTTGAGTGCTTCAAGTAGTGTGTGCCCGTC

TGTTGTGTGACTCTGGTAACTAGAGATCCCTCAGACCCTTTTAGTCAGTGTGGAAAATC

TCTAGCAGGGCCCGTTTAAACCCGCTGATCAGCCTCGACTGTGCCTTCTAGTTGCCAGC

CATCTGTTGTTTGCCCCTCCCCCGTGCCTTCCTTGACCCTGGAAGGTGCCACTCCCACT

GTCCTTTCCTAATAAAATGAGGAAATTGCATCGCATTGTCTGAGTAGGTGTCATTCTATT

CTGGGGGGTGGGGTGGGGCAGGACAGCAAGGGGGAGGATTGGGAAGACAATAGCAG

GCATGCTGGGGATGCGGTGGGCTCTATGGCTTCTGAGGCGGAAAGAACCAGCTGGGGC

TCTAGGGGTATCCCCACGCGCCCTGTAGCGGCGCATTAAGCGCGGCGGGTGTGGTGG

TTACGCGCAGCGTGACCGCTACACTTGCCAGCGCCCTAGCGCCCGCTCCTTTCGCTTTC

TTCCCTTCCTTTCTCGCCACGTTCGCCGGCTTTCCCCGTCAAGCTCTAAATCGGGGGCT

CCCTTTAGGGTTCCGATTTAGTGCTTTACGGCACCTCGACCCCAAAAAACTTGATTAGG

GTGATGGTTCACGTAGTGGGCCATCGCCCTGATAGACGGTTTTTCGCCCTTTGACGTTG

GAGTCCACGTTCTTTAATAGTGGACTCTTGTTCCAAACTGGAACAACACTCAACCCTAT

CTCGGTCTATTCTTTTGATTTATAAGGGATTTTGCCGATTTCGGCCTATTGGTTAAAAAT

GAGCTGATTTAACAAAAATTTAACGCGAATTAATTCTGTGGAATGTGTGTCAGTTAGGG

TGTGGAAAGTCCCCAGGCTCCCCAGCAGGCAGAAGTATGCAAAGCATGCATCTCAATT

AGTCAGCAACCAGGTGTGGAAAGTCCCCAGGCTCCCCAGCAGGCAGAAGTATGCAAA

```
GCATGCATCTCAATTAGTCAGCAACCATAGTCCCGCCCCTAACTCCGCCCATCCCGCCC
CTAACTCCGCCCAGTTCCGCCCATTCTCCGCCCCATGGCTGACTAATTTTTTTATTTATG
CAGAGGCCGAGGCCGCCTCTGCCTCTGAGCTATTCCAGAAGTAGTGAGGAGGCTTTTT
TGGAGGCCTAGGCTTTTGCAAAAAGCTCCCGGGAGCTTGTATATCCATTTTCGGATCTG
ATCAGCACGTGTTGACAATTAATCATCGGCATAGTATATCGGCATAGTATAATACGACAA
GGTGAGGAACTAAACCATGGCCAAGTTGACCAGTGCCGTTCCGGTGCTCACCGCGCGC
GACGTCGCCGGAGCGGTCGAGTTCTGGACCGACCGGCTCGGGTTCTCCCGGGACTTCG
TGGAGGACGACTTCGCCGGTGTGGTCCGGGACGACGTGACCCTGTTCATCAGCGCGGT
CCAGGACCAGGTGGTGCCGGACAACACCCTGGCCTGGGTGTGGGTGCGCGGCCTGGA
CGAGCTGTACGCCGAGTGGTCGGAGGTCGTGTCCACGAACTTCCGGGACGCCTCCGG
GCCGGCCATGACCGAGATCGGCGAGCAGCCGTGGGGCGGGAGTTCGCCCTGCGCGA
CCCGGCCGGCAACTGCGTGCACTTCGTGGCCGAGGAGCAGGACTGACACGTGCTACG
AGATTTCGATTCCACCGCCGCCTTCTATGAAAGGTTGGGCTTCGGAATCGTTTTCCGGG
ACGCCGGCTGGATGATCCTCCAGCGCGGGGATCTCATGCTGGAGTTCTTCGCCCACCCC
AACTTGTTTATTGCAGCTTATAATGGTTACAAATAAAGCAATAGCATCACAAATTTCACA
AATAAAGCATTTTTTTCACTGCATTCTAGTTGTGGTTTGTCCAAACTCATCAATGTATCT
TATCATGTCTGTATACCGTCGACCTCTAGCTAGAGCTTGGCGTAATCATGGTCATAGCTG
TTTCCTGTGTGAAATTGTTATCCGCTCACAATTCCACACAACATACGAGCCGGAAGCAT
AAAGTGTAAAGCCTGGGGTGCCTAATGAGTGAGCTAACTCACATTAATTGCGTTGCGCT
CACTGCCCGCTTTCCAGTCGGGAAACCTGTCGTGCCAGCTGCATTAATGAATCGGCCA
ACGCGCGGGGAGAGGCGGTTTGCGTATTGGGCGCTCTTCCGCTTCCTCGCTCACTGAC
TCGCTGCGCTCGGTCGTTCGGCTGCGGCGAGCGGTATCAGCTCACTCAAAGGCGGTAA
TACGGTTATCCACAGAATCAGGGGATAACGCAGGAAAGAACATGTGAGCAAAAGGCC
AGCAAAAGGCCAGGAACCGTAAAAAGGCCGCGTTGCTGGCGTTTTTCCATAGGCTCCG
CCCCCCTGACGAGCATCACAAAAATCGACGCTCAAGTCAGAGGTGGCGAAACCCGAC
AGGACTATAAAGATACCAGGCGTTTCCCCCTGGAAGCTCCCTCGTGCGCTCTCCTGTTC
CGACCCTGCCGCTTACCGGATACCTGTCCGCCTTTCTCCCTTCGGGAAGCGTGGCGCTT
TCTCATAGCTCACGCTGTAGGTATCTCAGTTCGGTGTAGGTCGTTCGCTCCAAGCTGGG
CTGTGTGCACGAACCCCCCGTTCAGCCCGACCGCTGCGCCTTATCCGGTAACTATCGTC
TTGAGTCCAACCCGGTAAGACACGACTTATCGCCACTGGCAGCAGCCACTGGTAACAG
GATTAGCAGAGCGAGGTATGTAGGCGGTGCTACAGAGTTCTTGAAGTGGTGGCCTAAC
TACGGCTACACTAGAAGAACAGTATTTGGTATCTGCGCTCTGCTGAAGCCAGTTACCTT
CGGAAAAAGAGTTGGTAGCTCTTGATCCGGCAAACAAACCACCGCTGGTAGCGGTGG
TTTTTTTGTTTGCAAGCAGCAGATTACGCGCAGAAAAAAAGGATCTCAAGAAGATCCT
TTGATCTTTTCTACGGGGTCTGACGCTCAGTGGAACGAAAACTCACGTTAAGGGATTTT
GGTCATGAGATTATCAAAAAGGATCTTCACCTAGATCCTTTTAAATTAAAAATGAAGTTT
TAAATCAATCTAAAGTATATATGAGTAAACTTGGTCTGACAGTTACCAATGCTTAATCAG
TGAGGCACCTATCTCAGCGATCTGTCTATTTCGTTCATCCATAGTTGCCTGACTCCCCGT
CGTGTAGATAACTACGATACGGGAGGGCTTACCATCTGGCCCCAGTGCTGCAATGATAC
CGCGAGACCCACGCTCACCGGCTCCAGATTTATCAGCAATAAACCAGCCAGCCGGAAG
GGCCGAGCGCAGAAGTGGTCCTGCAACTTTATCCGCCTCCATCCAGTCTATTAATTGTT
```

-continued

```
GCCGGGAAGCTAGAGTAAGTAGTTCGCCAGTTAATAGTTTGCGCAACGTTGTTGCCATT

GCTACAGGCATCGTGGTGTCACGCTCGTCGTTTGGTATGGCTTCATTCAGCTCCGGTTC

CCAACGATCAAGGCGAGTTACATGATCCCCCATGTTGTGCAAAAAAGCGGTTAGCTCC

TTCGGTCCTCCGATCGTTGTCAGAAGTAAGTTGGCCGCAGTGTTATCACTCATGGTTAT

GGCAGCACTGCATAATTCTCTTACTGTCATGCCATCCGTAAGATGCTTTTCTGTGACTGG

TGAGTACTCAACCAAGTCATTCTGAGAATAGTGTATGCGGCGACCGAGTTGCTCTTGCC

CGGCGTCAATACGGGATAATACCGCGCCACATAGCAGAACTTTAAAAGTGCTCATCATT

GGAAAACGTTCTTCGGGGCGAAAACTCTCAAGGATCTTACCGCTGTTGAGATCCAGTT

CGATGTAACCCACTCGTGCACCCAACTGATCTTCAGCATCTTTTACTTTCACCAGCGTTT

CTGGGTGAGCAAAAACAGGAAGGCAAAATGCCGCAAAAAAGGGAATAAGGGCGACA

CGGAAATGTTGAATACTCATACTCTTCCTTTTTCAATATTATTGAAGCATTTATCAGGGTT

ATTGTCTCATGAGCGGATACATATTTGAATGTATTTAGAAAAATAAACAAATAGGGG

TTCCGCGCACATTTCCCCGAAAAGTGCCACCTGAC
``` hSvnpromotor
*C-termNpu*
C-termwtCas9 pLenti-U6-DNMT1_nicking_sgRNA:

```
TAACAAATTGGCTGTGGTATATAAAATTATTCATAATGATAGTAGGAGGCTTGGTAGGTT       (SEQ ID NO: 738)

TAAGAATAGTTTTTGCTGTACTTTCTATAGTGAATAGAGTTAGGCAGGGATATTCACCAT

TATCGTTTCAGACCCACCTCCCAACCCCGAGGGGACCCAGAGAGGGCCTATTTCCCATG

ATTCCTTCATATTTGCATATACGATACAAGGCTGTTAGAGAGATAATIAGAATTAATTTGACTGT

AAACACAAAGATATTAGTACAAAATACGTGACGTAGAAAGTAATAATTTCTTGGGTAGTTTGCA

GTTTTAAAATTATGTTTTAAAATGGACTATCATATGCTTACCGTAACTTGAAAGTATTTCGATTTC

TTGGCTATATATCTTGTGGAAAGGACGAAACACCGCCGCGCGCGCGAAAAAGCCGGTTT

TAGAGCTAGAAATAGCAAGTTAAAATAAGGCTAGTCCGTTATCAACTTGAAAAAGTGGCA

CCGAGTCGGTGCTTTTTTAAGCTTGGCGTAACTAGATCTTGAGACAAATGGCAGTATTC

ATCCACAATTTTAAAAGAAAAGGGGGGATTGGGGGGTACAGTGCAGGGGAAAGAATA

GTAGACATAATAGCAACAGACATACAAACTAAAGAATTACAAAAACAAATTACAAAAA

TTCAAAATTTTCGGGTTTATTACAGGGACAGCAGAGATCCACTTTGGCGCCGGCTCGAG

GGGGCCCGGGTGCAAAGATGGATAAAGTTTTAAACAGAGAGGAATCTTTGCAGCTAAT

GGACCTTCTAGGTCTTGAAAGGAGTGGGAATTGGCTCCGGTGCCCGTCAGTGGGCAGA

GCGCACATCGCCCACAGTCCCCGAGAAGTTGGGGGAGGGGTCGGCAATTGATCCGG

TGCCTAGAGAAGGTGGCGCGGGGTAAACTGGGAAAGTGATGTCGTGTACTGGCTCCGC

CTTTTTCCCGAGGGTGGGGGAGAACCGTATATAAGTGCAGTAGTCGCCGTGAACGTTCT

TTTTCGCAACGGGTTTGCCGCCAGAACACAGGTAAGTGCCGTGTGTGGTTCCCGCGGG

CCTGGCCTCTTTACGGGTTATGGCCCTTGCGTGCCTTGAATTACTTCCACCTGGCTGCA

GTACGTGATTCTTGATCCCGAGCTTCGGGTTGGAAGTGGGTGGGAGAGTTCGAGGCCT

TGCGCTTAAGGAGCCCCTTCGCCTCGTGCTTGAGTTGAGGCCTGGCCTGGGCGCTGGG

GCCGCCGCGTGCGAATCTGGTGGCACCTTCGCGCCTGTCTCGCTGCTTTCGATAAGTCT

CTAGCCATTTAAAATTTTTGATGACCTGCTGCGACGCTTTTTTTCTGGCAAGATAGTCTT

GTAAATGCGGGCCAAGATCTGCACACTGGTATTTCGGTTTTTGGGGCCGCGGGCGGCG
```

-continued

```
ACGGGGCCCGTGCGTCCCAGCGCACATGTTCGGCGAGGCGGGGCCTGCGAGCGCGGC

CACCGAGAATCGGACGGGGGTAGTCTCAAGCTGGCCGGCCTGCTCTGGTGCCTGGCCT

CGCGCCGCCGTGTATCGCCCCGCCCTGGGCGGCAAGGCTGGCCCGGTCGGCACCAGTT

GCGTGAGCGGAAAGATGGCCGCTTCCCGGCCCTGCTGCAGGGAGCTCAAAATGGAGG

ACGCGGCGCTCGGGAGAGCGGGCGGGTGAGTCACCCACACAAAGGAAAAGGGCCTT

TCCGTCCTCAGCCGTCGCTTCATGTGACTCCACGGAGTACCGGGCGCCGTCCAGGCAC

CTCGATTAGTTCTCGAGCTTTTGGAGTACGTCGTCTTTAGGTTGGGGGGAGGGGTTTTA

TGCGATGGAGTTTCCCCACACTGAGTGGGTGGAGACTGAAGTTAGGCCAGCTTGGCAC

TTGATGTAATTCTCCTTGGAATTTGCCCTTTTTGAGTTTGGATCTTGGTTCATTCTCAAG

CCTCAGACAGTGGTTCAAAGTTTTTTTCTTCCATTTCAGGTGTCGTGACGTACGGCCAC

CATGACCGAGTACAAGCCCACGGTGCGCCTCGCCACCCGCGACGACGTCCCCAGGGC

CGTACGCACCCTCGCCGCCGCGTTCGCCGACTACCCCGCCACGCGCCACACCGTCGAT

CCGGACCGCCACATCGAGCGGGTCACCGAGCTGCAAGAACTCTTCCTCACGCGCGTCG

GGCTCGACATCGGCAAGGTGTGGGTCGCGGACGACGGCGCCGCCGTGGCGGTCTGGA

CCACGCCGGAGAGCGTCGAAGCGGGGGCGGTGTTCGCCGAGATCGGCCCGCGCATGG

CCGAGTTGAGCGGTTCCCGGCTGGCCGCGCAGCAACAGATGGAAGGCCTCCTGGCGC

CGCACCGGCCCAAGGAGCCCGCGTGGTTCCTGGCCACCGTCGGAGTCTCGCCCGACC

ACCAGGGCAAGGGTCTGGGCAGCGCCGTCGTGCTCCCCGGAGTGGAGGCGGCCGAGC

GCGCCGGGGTGCCCGCCTTCCTGGAGACCTCCGCGCCCCGCAACCTCCCCTTCTACGA

GCGGCTCGGCTTCACCGTCACCGCCGACGTCGAGGTGCCCGAAGGACCGCGCACCTG

GTGCATGACCCGCAAGCCCGGTGCCTGAACGCGTTAAGTCGACAATCAACCTCTGGAT

TACAAAATTTGTGAAAGATTGACTGGTATTCTTAACTATGTTGCTCCTTTTACGCTATGT

GGATACGCTGCTTTAATGCCTTTGTATCATGCTATTGCTTCCCGTATGGCTTTCATTTTCT

CCTCCTTGTATAAATCCTGGTTGCTGTCTCTTTATGAGGAGTTGTGGCCCGTTGTCAGGC

AACGTGGCGTGGTGTGCACTGTGTTTGCTGACGCAACCCCCACTGGTTGGGGCATTGC

CACCACCTGTCAGCTCCTTTCCGGGACTTTCGCTTTCCCCCTCCCTATTGCCACGGCGG

AACTCATCGCCGCCTGCCTTGCCCGCTGCTGGACAGGGGCTCGGCTGTTGGGCACTGA

CAATTCCGTGGTGTTGTCGGGGAAATCATCGTCCTTTCCTTGGCTGCTCGCCTGTGTTG

CCACCTGGATTCTGCGCGGGACGTCCTTCTGCTACGTCCCTTCGGCCCTCAATCCAGCG

GACCTTCCTTCCCGCGGCCTGCTGCCGGCTCTGCGGCCTCTTCCGCGTCTTCGCCTTCG

CCCTCAGACGAGTCGGATCTCCCTTTGGGCCGCCTCCCCGCGTCGACTTTAAGACCAAT

GACTTACAAGGCAGCTGTAGATCTTAGCCACTTTTTAAAAGAAAAGGGGGACTGGAA

GGGCTAATTCACTCCCAACGAAGACAAGATCTGCTTTTTGCTTGTACTGGGTCTCTCTG

GTTAGACCAGATCTGAGCCTGGGAGCTCTCTGGCTAACTAGGGAACCCACTGCTTAAG

CCTCAATAAAGCTTGCCTTGAGTGCTTCAAGTAGTGTGTGCCCGTCTGTTGTGTGACTC

TGGTAACTAGAGATCCCTCAGACCCTTTTAGTCAGTGTGGAAAATCTCTAGCAGTACGT

ATAGTAGTTCATGTCATCTTATTATTCAGTATTTATAACTTGCAAAGAAATGAATATCAGA

GAGTGAGAGGAACTTGTTTATTGCAGCTTATAATGGTTACAAATAAAGCAATAGCATCA

CAAATTTCACAAATAAAGCATTTTTTTCACTGCATTCTAGTTGTGGTTTGTCCAAACTCA

TCAATGTATCTTATCATGTCTGGCTCTAGCTATCCCGCCCCTAACTCCGCCCATCCCGCC
```

-continued

CCTAACTCCGCCCAGTTCCGCCCATTCTCCGCCCCATGGCTGACTAATTTTTTTTATTTAT
GCAGAGGCCGAGGCCGCCTCGGCCTCTGAGCTATTCCAGAAGTAGTGAGGAGGCTTTT
TTGGAGGCCTAGGGACGTACCCAATTCGCCCTATAGTGAGTCGTATTACGCGCGCTCAC
TGGCCGTCGTTTTACAACGTCGTGACTGGGAAAACCCTGGCGTTACCCAACTTAATCG
CCTTGCAGCACATCCCCCTTTCGCCAGCTGGCGTAATAGCGAAGAGGCCCGCACCGAT
CGCCCTTCCCAACAGTTGCGCAGCCTGAATGGCGAATGGGACGCGCCCTGTAGCGGCG
CATTAAGCGCGGCGGGTGTGGTGGTTACGCGCAGCGTGACCGCTACACTTGCCAGCGC
CCTAGCGCCCGCTCCTTTCGCTTTCTTCCCTTCCTTTCTCGCCACGTTCGCCGGCTTTCC
CCGTCAAGCTCTAAATCGGGGGCTCCCTTTAGGGTTCCGATTTAGTGCTTTACGGCACC
TCGACCCCAAAAAACTTGATTAGGGTGATGGTTCACGTAGTGGGCCATCGCCCTGATAG
ACGGTTTTTCGCCCTTTGACGTTGGAGTCCACGTTCTTTAATAGTGGACTCTTGTTCCA
AACTGGAACAACACTCAACCCTATCTCGGTCTATTCTTTTGATTTATAAGGGATTTTGCC
GATTTCGGCCTATTGGTTAAAAAATGAGCTGATTTAACAAAAATTTAACGCGAATTTTA
ACAAAATATTAACGCTTACAATTTAGGTGGCACTTTTCGGGGAAATGTGCGCGGAACCC
CTATTTGTTTATTTTTCTAAATACATTCAAATATGTATCCGCTCATGAGACAATAACCCTG
ATAAATGCTTCAATAATATTGAAAAAGGAAGAGTATGAGTATTCAACATTTCCGTGTCGC
CCTTATTCCCTTTTTTGCGGCATTTTGCCTTCCTGTTTTTGCTCACCCAGAAACGCTGGT
GAAAGTAAAAGATGCTGAAGATCAGTTGGGTGCACGAGTGGGTTACATCGAACTGGAT
CTCAACAGCGGTAAGATCCTTGAGAGTTTTCGCCCCGAAGAACGTTTTCCAATGATGA
GCACTTTTAAAGTTCTGCTATGTGGCGCGGTATTATCCCGTATTGACGCCGGGCAAGAG
CAACTCGGTCGCCGCATACACTATTCTCAGAATGACTTGGTTGAGTACTCACCAGTCAC
AGAAAAGCATCTTACGGATGGCATGACAGTAAGAGAATTATGCAGTGCTGCCATAACC
ATGAGTGATAACACTGCGGCCAACTTACTTCTGACAACGATCGGAGGACCGAAGGAGC
TAACCGCTTTTTTGCACAACATGGGGGATCATGTAACTCGCCTTGATCGTTGGGAACCG
GAGCTGAATGAAGCCATACCAAACGACGAGCGTGACACCACGATGCCTGTAGCAATGG
CAACAACGTTGCGCAAACTATTAACTGGCGAACTACTTACTCTAGCTTCCCGGCAACA
ATTAATAGACTGGATGGAGGCGGATAAAGTTGCAGGACCACTTCTGCGCTCGGCCCTTC
CGGCTGGCTGGTTTATTGCTGATAAATCTGGAGCCGGTGAGCGTGGGTCTCGCGGTATC
ATTGCAGCACTGGGGCCAGATGGTAAGCCCTCCCGTATCGTAGTTATCTACACGACGGG
GAGTCAGGCAACTATGGATGAACGAAATAGACAGATCGCTGAGATAGGTGCCTCACTG
ATTAAGCATTGGTAACTGTCAGACCAAGTTTACTCATATATACTTTAGATTGATTTAAAA
CTTCATTTTTAATTTAAAAGGATCTAGGTGAAGATCCTTTTTGATAATCTCATGACCAAA
ATCCCTTAACGTGAGTTTTCGTTCCACTGAGCGTCAGACCCCGTAGAAAAGATCAAAG
GATCTTCTTGAGATCCTTTTTTTCTGCGCGTAATCTGCTGCTTGCAAACAAAAAAACCA
CCGCTACCAGCGGTGGTTTGTTTGCCGGATCAAGAGCTACCAACTCTTTTTCCGAAGGT
AACTGGCTTCAGCAGAGCGCAGATACCAAATACTGTTCTTCTAGTGTAGCCGTAGTTAG
GCCACCACTTCAAGAACTCTGTAGCACCGCCTACATACCTCGCTCTGCTAATCCTGTTA
CCAGTGGCTGCTGCCAGTGGCGATAAGTCGTGTCTTACCGGGTTGGACTCAAGACGAT
AGTTACCGGATAAGGCGCAGCGGTCGGGCTGAACGGGGGGTTCGTGCACACAGCCCA
GCTTGGAGCGAACGACCTACACCGAACTGAGATACCTACAGCGTGAGCTATGAGAAAG
CGCCACGCTTCCCGAAGGGAGAAAGGCGGACAGGTATCCGGTAAGCGGCAGGGTCGG

```
AACAGGAGAGCGCACGAGGGAGCTTCCAGGGGGAAACGCCTGGTATCTTTATAGTCCT

GTCGGGTTTCGCCACCTCTGACTTGAGCGTCGATTTTTGTGATGCTCGTCAGGGGGCG

GAGCCTATGGAAAAACGCCAGCAACGCGGCCTTTTTACGGTTCCTGGCCTTTTGCTGG

CCTTTTGCTCACATGTTCTTTCCTGCGTTATCCCCTGATTCTGTGGATAACCGTATTACCG

CCTTTGAGTGAGCTGATACCGCTCGCCGCAGCCGAACGACCGAGCGCAGCGAGTCAGT

GAGCGAGGAAGCGGAAGAGCGCCCAATACGCAAACCGCCTCTCCCCGCGCGTTGGCC

GATTCATTAATGCAGCTGGCACGACAGGTTTCCCGACTGGAAAGCGGGCAGTGAGCGC

AACGCAATTAATGTGAGTTAGCTCACTCATTAGGCACCCCAGGCTTTACACTTTATGCTT

CCGGCTCGTATGTTGTGTGGAATTGTGAGCGGATAACAATTTCACACAGGAAACAGCT

ATGACCATGATTACGCCAAGCGCGCAATTAACCCTCACTAAAGGGAACAAAAGCTGGA

GCTGCAAGCTTAATGTAGTCTTATGCAATACTCTTGTAGTCTTGCAACATGGTAACGATG

AGTTAGCAACATGCCTTACAAGGAGAGAAAAAGCACCGTGCATGCCGATTGGTGGAA

GTAAGGTGGTACGATCGTGCCTTATTAGGAAGGCAACAGACGGGTCTGACATGGATTG

GACGAACCACTGAATTGCCGCATTGCAGAGATATTGTATTTAAGTGCCTAGCTCGATAC

ATAAACGGGTCTCTCTGGTTAGACCAGATCTGAGCCTGGGAGCTCTCTGGCTAACTAGG

GAACCCACTGCTTAAGCCTCAATAAAGCTTGCCTTGAGTGCTTCAAGTAGTGTGTGCCC

GTCTGTTGTGTGACTCTGGTAACTAGAGATCCCTCAGACCCTTTTAGTCAGTGTGGAAA

ATCTCTAGCAGTGGCGCCCGAACAGGGACTTGAAAGCGAAAGGGAAACCAGAGGAGC

TCTCTCGACGCAGGACTCGGCTTGCTGAAGCGCGCACGGCAAGAGGCGAGGGGCGGC

GACTGGTGAGTACGCCAAAAATTTTGACTAGCGGAGGCTAGAAGGAGAGAGATGGGT

GCGAGAGCGTCAGTATTAAGCGGGGGAGAATTAGATCGCGATGGGAAAAAATTCGGTT

AAGGCCAGGGGGAAAGAAAAAATATAAATTAAAACATATAGTATGGGCAAGCAGGGAG

CTAGAACGATTCGCAGTTAATCCTGGCCTGTTAGAAACATCAGAAGGCTGTAGACAAAT

ACTGGGACAGCTACAACCATCCCTTCAGACAGGATCAGAAGAACTTAGATCATTATATA

ATACAGTAGCAACCCTCTATTGTGTGCATCAAAGGATAGAGATAAAAGACACCAAGGA

AGCTTTAGACAAGATAGAGGAAGAGCAAAACAAAAGTAAGACCACCGCACAGCAAGC

GGCCGCTGATCTTCAGACCTGGAGGAGGAGATATGAGGGACAATTGGAGAAGTGAATT

ATATAAATATAAAGTAGTAAAAATTGAACCATTAGGAGTAGCACCCACCAAGGCAAAGA

GAAGAGTGGTGCAGAGAGAAAAAAGAGCAGTGGGAATAGGAGCTTTGTTCCTTGGGT

TCTTGGGAGCAGCAGGAAGCACTATGGGCGCAGCGTCAATGACGCTGACGGTACAGG

CCAGACAATTATTGTCTGGTATAGTGCAGCAGCAGAACAATTTGCTGAGGGCTATTGAG

GCGCAACAGCATCTGTTGCAACTCACAGTCTGGGGCATCAAGCAGCTCCAGGCAAGA

ATCCTGGCTGTGGAAAGATACCTAAAGGATCAACAGCTCCTGGGGATTTGGGGTTGCT

CTGGAAAACTCATTTGCACCACTGCTGTGCCTTGGAATGCTAGTTGGAGTAATAAATCT

CTGGAACAGATTTGGAATCACACGACCTGGATGGAGTGGGACAGAGAAATTAACAATT

ACACAAGCTTAATACACTCCTTAATTGAAGAATCGCAAAACCAGCAAGAAAAGAATGA

ACAAGAATTATTGGAATTAGATAAATGGGCAAGTTTGTGGAATTGGTTTAACA
```
*U6promoter* sgRNA

Amino acid sequences of Maloney murine leukemia virus reverse transcriptase (M-MLV RT) variants used herein.

PE1 M-MLV RT:

(SEQ ID NO: 739)

TLNIEDEYRLHETSKEPDVSLGSTWLSDFPQAWAETGGMGLAVRQAPLIIPLKATSTP

VSIKQYPMSQEARLGIKPHIQRLLDQGILVPCQSPWNTPLLPVKKPGTNDYRPVQDLR

EVNKRVEDIHPTVPNPYNLLSGLPPSHQWYTVLDLKDAFFCLRLHPTSQPLFAFEWR

DPEMGISGQLTWTRLPQGFKNSPTLFDEALHRDLADFRIQHPDLILLQYVDDLLLAAT

SELDCQQGTRALLQTLGNLGYRASAKKAQICQKQVKYLGYLLKEGQRWLTEARKET

VMGQPTPKTPRQLREFLGTAGFCRLWIPGFAEMAAPLYPLTKTGTLFNWGPDQQKAY

QEIKQALLTAPALGLPDLTKPFELFVDEKQGYAKGVLTQKLGPWRRPVAYLSKKLDPV

AAGWPPCLRMVAAIAVLTKDAGKLTMGQPLVILAPHAVEALVKQPPDRWLSNARMT

HYQALLLDTDRVQFGPVVALNPATLLPLPEEGLQHNCLDILAEAHGTRPDLTDQPLPD

ADHTWYTDGSSLLQEGQRKAGAAVTTETEVIWAKALPAGTSAQRAELIALTQALKM

AEGKKLNVYTDSRYAFATAHIHGEIYRRRGLLTSEGKEIKNKDEILALLKALFLPKRLS

IIHCPGHQKGHSAEARGNRMADQAARKAAITETPDTSTLLIENSSP

M3 M-MLV RT (D200N, T330P, L603W) (see Baranauskas et al.[182]):

(SEQ ID NO: 740)

TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFN

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKPGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGWLTSEGKEIKNKDEILALLKALFLPKRLSIIHCPGHQKGHSAEARGNR

MADQAARKAAITETPDTSTLLIENSSP

PE2 M-MLV RT (D200N, T306K, W313F, T330P, L603W):

(SEQ ID NO: 741)

TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFN

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

-continued

REFLGKAGFCRLFIPGFAEMAAPLYPLTKPGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGWLTSEGKEIKNKDEILALLKALFLPKRLSIIHCPGHQKGHSAE

ARGNRMADQAARKAAITETPDTSTLLIENSSP

M3-deadRT M-MLV RT:

(SEQ ID NO: 742)

TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKLPGTNDYSPVQDLREVNKRVEDIHPTVPNPYNLLSGLPPSHQWYTVLD

LKDAFFCLRLHPTSQPLFAFEWRDPEMGISGQLTWTRLPQGFKNSPTLFN

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKPGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGWLTSEGKEIKNKDEILALLKALFLPKRLSIIHCPGHQKGHSAEARGNR

MADQAARKAAITETPDTSTLLIENSSP

References for Example 12

Each of the following references are cited in Example 12, each of which are incorporated herein by reference.

1. Landrum, M. J. et al. ClinVar: public archive of interpretations of clinically relevant variants. *Nucleic Acids Res.* 44, D862-D868 (2016).
2. Jinek, M. et al. A Programmable Dual-RNA-Guided DNA Endonuclease in Adaptive Bacterial Immunity. *Science* 337, 816-821 (2012).
3. Cong, L. et al. Multiplex Genome Engineering Using CRISPR/Cas Systems. *Science* 339, 819-823 (2013).
4. Mali, P. et al. RNA-Guided Human Genome Engineering via Cas9. *Science* 339, 823-826 (2013).
5. Yang, H. et al. One-Step Generation of Mice Carrying Reporter and Conditional Alleles by CRISPR/Cas-Mediated Genome Engineering. *Cell* 154, 1370-1379 (2013).
6. Kim, S., Kim, D., Cho, S. W., Kim, J. & Kim, J.-S. Highly efficient RNA-guided genome editing in human cells via delivery of purified Cas9 ribonucleoproteins. *Genome Res.* 24, 1012-1019 (2014).
7. Orlando, S. J. et al. Zinc-finger nuclease-driven targeted integration into mammalian genomes using donors with limited chromosomal homology. *Nucleic Acids Res.* 38, e152-e152 (2010).
8. Tsai, S. Q. et al. GUIDE-seq enables genome-wide profiling of off-target cleavage by CRISPRCas nucleases. *Nat. Biotechnol.* 33, 187-197 (2015).
9. Suzuki, K. et al. In vivo genome editing via CRISPR/Cas9 mediated homology-independent targeted integration. *Nature* 540, 144-149 (2016).
10. Kosicki, M., Tomberg, K. & Bradley, A. Repair of double-strand breaks induced by CRISPR-Cas9 leads to large deletions and complex rearrangements. *Nat. Biotechnol.* 36, 765-771 (2018).
11. Haapaniemi, E., Botla, S., Persson, J., Schmierer, B. & Taipale, J. CRISPR-Cas9 genome editing induces a p53-mediated DNA damage response. *Nat. Med.* 24, 927-930 (2018).
12. Ihry, R. J. et al. p53 inhibits CRISPR-Cas9 engineering in human pluripotent stem cells. *Nat. Med.* 24, 939-946 (2018).
13. Rouet, P., Smih, F. & Jasin, M. Expression of a site-specific endonuclease stimulates homologous recombination in mammalian cells. *Proc. Natl. Acad. Sci.* 91, 6064-6068 (1994).
14. Chapman, J. R., Taylor, M. R. G. & Boulton, S. J. Playing the end game: DNA double-strand break repair pathway choice. *Mol. Cell* 47, 497-510 (2012).
15. Cox, D. B. T., Platt, R. J. & Zhang, F. Therapeutic genome editing: prospects and challenges. *Nat. Med.* 21, 121-131 (2015).
16. Paquet, D. et al. Efficient introduction of specific homozygous and heterozygous mutations using CRISPR/Cas9. *Nature* 533, 125-129 (2016).
17. Chu, V. T. et al. Increasing the efficiency of homology-directed repair for CRISPR-Cas9-induced precise gene editing in mammalian cells. *Nat. Biotechnol.* 33, 543-548 (2015).
18. Maruyama, T. et al. Increasing the efficiency of precise genome editing with CRISPR-Cas9 by inhibition of non-homologous end joining. *Nat. Biotechnol.* 33, 538-542 (2015).
19. Rees, H. A., Yeh, W.-H. & Liu, D. R. Development of hRad51-Cas9 nickase fusions that mediate HDR without double-stranded breaks. *Nat. Commun.* 10, 1-12 (2019).
20. Shen, M. W. et al. Predictable and precise template-free CRISPR editing of pathogenic variants. *Nature* 563, 646-651 (2018).
21. Rees, H. A. & Liu, D. R. Base editing: precision chemistry on the genome and transcriptome of living cells. *Nat. Rev. Genet.* 19, 770 (2018).
22. Komor, A. C., Kim, Y. B., Packer, M. S., Zuris, J. A. & Liu, D. R. Programmable editing of a target base in genomic DNA without double-stranded DNA cleavage. *Nature* 533, 420-424 (2016).
23. Gaudelli, N. M. et al. Programmable base editing of A.T to G.C in genomic DNA without DNA cleavage. *Nature* 551, 464-471 (2017).
24. Gao, X. et al. Treatment of autosomal dominant hearing loss by in vivo delivery of genome editing agents. *Nature* 553, 217-221 (2018).
25. Ingram, V. M. A specific chemical difference between the globins of normal human and sickle-cell anaemia haemoglobin. *Nature* 178, 792-794 (1956).
26. Myerowitz, R. & Costigan, F. C. The major defect in Ashkenazi Jews with Tay-Sachs disease is an insertion in the gene for the alpha-chain of beta-hexosaminidase. *J. Biol. Chem.* 263, 18587-18589 (1988).
27. Zielenski, J. Genotype and Phenotype in Cystic Fibrosis. *Respiration* 67, 117-133 (2000).
28. Mead, S. et al. A Novel Protective Prion Protein Variant that Colocalizes with Kuru Exposure. *N. Engl. J. Med.* 361, 2056-2065 (2009).
29. Marraffini, L. A. & Sontheimer, E. J. CRISPR interference limits horizontal gene transfer in staphylococci by targeting DNA. *Science* 322, 1843-1845 (2008).
30. Barrangou, R. et al. CRISPR provides acquired resistance against viruses in prokaryotes. *Science* 315, 1709-1712 (2007).
31. Jiang, F. & Doudna, J. A. CRISPR-Cas9 Structures and Mechanisms. *Annu. Rev. Biophys.* 46, 505-529 (2017).
32. Hille, F. et al. The Biology of CRISPR-Cas: Backward and Forward. *Cell* 172, 1239-1259 (2018).
33. Luan, D. D., Korman, M. H., Jakubczak, J. L. & Eickbush, T. H. Reverse transcription of R2Bm RNA is primed by a nick at the chromosomal target site: a mechanism for non-LTR retrotransposition. Cell 72, 595-605 (1993).
34. Liu, Y., Kao, H.-I. & Bambara, R. A. Flap endonuclease 1: a central component of DNA metabolism. *Annu. Rev. Biochem.* 73, 589-615 (2004).
35. Richardson, C. D., Ray, G. J., DeWitt, M. A., Curie, G. L. & Corn, J. E. Enhancing homology directed genome editing by catalytically active and inactive CRISPR-Cas9 using asymmetric donor DNA. *Nat. Biotechnol.* 34, 339-344 (2016).
36. Qi, L. S. et al. Repurposing CRISPR as an RNA-Guided Platform for Sequence-Specific Control of Gene Expression. *Cell* 152, 1173-1183 (2013).
37. Shechner, D. M., Hacisuleyman, E., Younger, S. T. & Rinn, J. L. Multiplexable, locus-specific targeting of long RNAs with CRISPR-Display. *Nat. Methods* 12, 664-670 (2015).
38. Tang, W., Hu, J. H. & Liu, D. R. Aptazyme-embedded guide RNAs enable ligand-responsive genome editing and transcriptional activation. *Nat. Commun.* 8, 15939 (2017).
39. Jinek, M. et al. Structures of Cas9 Endonucleases Reveal RNA-Mediated Conformational Activation. *Science* 343, 1247997 (2014).

40. Nishimasu, H. et al. Crystal Structure of Cas9 in Complex with Guide RNA and Target DNA. *Cell* 156, 935-949 (2014).
41. Jiang, F., Zhou, K., Ma, L., Gressel, S. & Doudna, J. A. A Cas9-guide RNA complex preorganized for target DNA recognition. *Science* 348, 1477-1481 (2015).
42. Baranauskas, A. et al. Generation and characterization of new highly thermostable and processive M-MuLV reverse transcriptase variants. *Protein Eng. Des. Sel.* 25, 657-668 (2012).
43. Gerard, G. F. et al. The role of template-primer in protection of reverse transcriptase from thermal inactivation. *Nucleic Acids Res.* 30, 3118-3129 (2002).
44. Arezi, B. & Hogrefe, H. Novel mutations in Moloney Murine Leukemia Virus reverse transcriptase increase thermostability through tighter binding to template-primer. *Nucleic Acids Res.* 37, 473-481 (2009).
45. Kotewicz, M. L., Sampson, C. M., D'Alessio, J. M. & Gerard, G. F. Isolation of cloned Moloney murine leukemia virus reverse transcriptase lacking ribonuclease H activity. *Nucleic Acids Res.* 16, 265-277 (1988).
46. Thuronyi, B. W. et al. Continuous evolution of base editors with expanded target compatibility and improved activity. *Nat. Biotechnol.* (2019). doi:10.1038/s41587-019-0193-0
47. Kim, Y. B. et al. Increasing the genome-targeting scope and precision of base editing with engineered Cas9-cytidine deaminase fusions. *Nat. Biotechnol.* 35, 371-376 (2017).
48. Koblan, L. W. et al. Improving cytidine and adenine base editors by expression optimization and ancestral reconstruction. *Nat. Biotechnol.* (2018). doi:10.1038/nbt.4172
49. Kleinstiver, B. P. et al. High-fidelity CRISPR-Cas9 nucleases with no detectable genome-wide off target effects. *Nature* 529, 490-495 (2016).
50. Zuo, E. et al. Cytosine base editor generates substantial off-target single-nucleotide variants in mouse embryos. *Science* 364, 289-292 (2019).
51. Jin, S. et al. Cytosine, but not adenine, base editors induce genome-wide off-target mutations in rice. *Science* 364, 292-295 (2019).
52. Kim, D., Kim, D., Lee, G., Cho, S.-I. & Kim, J.-S. Genome-wide target specificity of CRISPR RNA guided adenine base editors. *Nat. Biotechnol.* 37, 430-435 (2019).
53. Grunewald, J. et al. Transcriptome-wide off-target RNA editing induced by CRISPR-guided DNA base editors. *Nature* 569, 433-437 (2019).
54. Zhou, C. et al. Off-target RNA mutation induced by DNA base editing and its elimination by mutagenesis. *Nature* 571, 275-278 (2019).
55. Rees, H. A., Wilson, C., Doman, J. L. & Liu, D. R. Analysis and minimization of cellular RNA editing by DNA adenine base editors. *Sci. Adv.* 5, eaax5717 (2019).
56. Ostertag, E. M. & Kazazian Jr, H. H. Biology of Mammalian L1 Retrotransposons. *Annu. Rev. Genet.* 35, 501-538 (2001).
57. Griffiths, D. J. Endogenous retroviruses in the human genome sequence. *Genome Biol.* 2, REVIEWS1017 (2001).
58. Berkhout, B., Jebbink, M. & Zsiros, J. Identification of an Active Reverse Transcriptase Enzyme Encoded by a Human Endogenous HERV-K Retrovirus. *J. Virol.* 73, 2365-2375 (1999).
59. Halvas, E. K., Svarovskaia, E. S. & Pathak, V. K. Role of Murine Leukemia Virus Reverse Transcriptase Deoxyribonucleoside Triphosphate-Binding Site in Retroviral Replication and In Vivo Fidelity. *J. Virol.* 74, 10349-10358 (2000).
60. Dever, D. P. et al. CRISPR/Cas9 Beta-globin Gene Targeting in Human Hematopoietic Stem Cells. *Nature* 539, 384-389 (2016).
61. Park, S. H. et al. Highly efficient editing of the β-globin gene in patient-derived hematopoietic stem and progenitor cells to treat sickle cell disease. *Nucleic Acids Res.* doi:10.1093/nar/gkz475
62. Collinge, J. Prion diseases of humans and animals: their causes and molecular basis. *Annu. Rev. Neurosci.* 24, 519-550 (2001).
63. Asante, E. A. et al. A naturally occurring variant of the human prion protein completely prevents prion disease. *Nature* 522, 478-481 (2015).
64. Zettler, J., Schutz, V. & Mootz, H. D. The naturally split Npu DnaE intein exhibits an extraordinarily high rate in the protein trans-splicing reaction. *FEBS Lett.* 583, 909-914 (2009).
65. Kugler, S., Kilic, E. & Bahr, M. Human synapsin 1 gene promoter confers highly neuron-specific long-term transgene expression from an adenoviral vector in the adult rat brain depending on the transduced area. *Gene Ther.* 10, 337-347 (2003).
66. de Felipe, P., Hughes, L. E., Ryan, M. D. & Brown, J. D. Co-translational, intraribosomal cleavage of polypeptides by the foot-and-mouth disease virus 2A peptide. *J. Biol. Chem.* 278, 11441-11448 (2003).

Example 13—Cell Data Recording and Lineage Tracing by PE

Background

Genome modification can be used to study and record cellular processes and development. Linking cellular events, like cell division or signaling cascade activation, to DNA sequence modifications stores cellular histories as interpretable DNA sequence changes that would describe whether specific cellular events had taken place. DNA editing is necessary for these applications because DNA is faithfully passed from one cell to the next in a way that RNA and proteins are not. Information relating to cellular state and lineage are in general lost when modifications are made to short-lived protein and RNA molecules. Recording cellular events within a single cell is a powerful way to understand how disease states are initiated, maintained, and changed relative to healthy controls. The ability to probe these questions has implications for understanding the development of cancer, neurological disease, and a host of other important problems in human health. prime editing (PE) provides a system for creating targeted and sequence-specified genomic insertions, deletions, or mutations. Repeated modification of a DNA target that can be sequenced by targeted amplicon sequencing and/or RNA sequencing (which is of particular value for single cell recording experiments) can be used to record a host of important biological processes, including activation of signaling cascades, metabolic states, and cellular differentiation programs. Connecting internal and external cellular signals to sequence modifications in the genome is, in theory, possible for any signal for which a signal responsive promoter exists. It is believed that PE enables a greatly expanded toolkit for probing the cellular lineage and the signaling histories of eukaryotic and prokaryotic cells in both cultured conditions and in vivo.

Previous Standards

Targeted sequence insertion, deletion, or mutation can be used to study a number of important biological questions including lineage tracing and recording of cellular stimuli. The current toolkit for generating these signatures in the genome is limited. Mutagenesis of target loci has been developed to date using both DNA-nucleases and base editors.

CRISPR/Cas9 nuclease cutting of target sequences generates stochastic sequence changes to generate a large number of insertion or deletion (indel) products. The large number of sequence outcomes that arise from Cas9 cutting allows for clear determination of sequences that have been cut by the nuclease. The ability to distinguish cut versus non-cut sequences has been used in two predominant ways.

First, the expression of the Cas9 nuclease and/or its single guide RNA (sgRNA) have been connected to cellular signals. Additionally, whether that signal has occurred based on sequence modifications to the Cas9 targeted genomic locus has been recorded. However, this approach is limited because each signal requires a unique target locus, which makes tracking the relative timing of multiple signals difficult to interpret. Another limitation to this approach is that multiple target loci are desired for a specific sgRNA because generation of an indel often severely hinders additional mutagenesis of the target locus; this often means that pre-engineered target loci are integrated into cells for editing instead of direct mutagenesis of endogenous loci.

Second, Cas9 indels have been used to track cellular lineages. As described herein, the large number of possible indel states generated by Cas9 nuclease activity allows for the generation of cellular developmental trees that suggest which cells have arisen from one another across time. This approach is a powerful way to understand how cells arise from one another and has been used to help identify unique cell states and types across developmental time by performing RNA sequencing on selected cellular pools. This approach cannot independently report on cellular signaling events, their order, and may have biases when reporting on pre-cursor versus terminally differentiated cell states.

Cas9 nuclease mediated lineage tracing and signal recording are powerful techniques that come with some important caveats. Signal recording with Cas9 nuclease is often very technically challenging. Cas9 cutting exhausts the target locus (repeated cutting is difficult once an indel is generated) making it difficult to record long term stimuli at the single cell level. The kinetics of Cas9 cutting can be tuned to enable longer term recording events though the ability to integrate the order, intensity, and duration of multiple stimuli remains a very challenging technical problem that may not be achievable with this tool. Cas9 lineage tracing experiments have been incredibly powerful but suffer from minor technical challenges of sequence collapse due to simultaneous Cas9 cuts at a target locus. These lineage-tracing experiments require editing of pre-designed target loci, limiting the flexibility of this approach.

DNA base editing has also been used to track cellular signaling events. Base editing is not well suited for lineage tracing due to the low number of outcome states generated by an editing event relative to the number of states generated by Cas9 indels; however, the pre-defined nature of the sequence modifications made by a base editor are particularly useful for tracking internal and external cellular stimuli. As described herein, either base editor or sgRNA expression can be connected to a particular biological or chemical stimulus. Base editing activity has been used to track a large number of individual stimuli in both mammalian and bacterial cells. This approach has also been used to track consecutive stimuli where a first editing event was necessary before a second edit could take place.

Base editing signal recording is an important first step for the field, but it has a number of limitations. One such limitation is that base editing exhausts its target after editing, limiting the dynamic range of the technique. This means that using endogenous targets for recording events is often difficult and limited to recording bulk activities instead of activity at the single cell level. An alternative to this is the introduction of a pre-designed repetitive recording locus though this has not been performed to date. There are also issues with two-signal recording. These two signal-recording experiments only report on the presence of the second stimulus after a first; it does not report which stimulus happened first or how long the stimuli were present. This fundamentally limits the biological understanding gleaned from the experiment.

It has been proposed that PE lineage tracing can do both lineage tracing and cellular signaling recording by modifying genomic target sequences as well as integrated pre-designed sequences. PE uses a synthetic fusion protein comprising a Cas9 nickase fragment (often the SpCas9 H840A variant) and a reverse transcriptase (RT) domain, along with an engineered prime editing guide RNA (PE-gRNA). Together, these components target a specific genomic sequence and install a pre-determined edit. Since the PEgRNA specifies both the target genomic sequence and the editing outcome, highly specific and controlled genome modification can be achieved simultaneously using multiple PEgRNAs within the same cell. Accessible genome modifications include all single nucleotide substitution, small to medium size sequence insertions, and small to medium size sequence deletions. The versatility of this genome editing technology should enable temporally coupled, signal-specific recording within cells.

Utility of PE Lineage and Cell Signaling Recording

Recording cellular signaling can be accomplished in a number of ways. One important first application of this approach is to connect DNA modification events to cell cycle associated signals like the expression of cyclins, CDKs, or other proteins specific to phases of the cellular life span one could generate a cellular clock. A cellular clock allows researchers to understand the order of various signals being received and processed by individual cells. A molecular clock would also enable the determination of long-term signaling versus short-term bursts of signaling. Using prime editing components that can only edit once a cell cycle could also lead to a molecular clock. If editing can only proceed once a cell cycle without continued DNA modification (perhaps by not nicking the non-edited DNA strand) one could imagine a system that only can be edited by a second targeting PEsgRNA in a subsequent cell division. PE is particularly useful as a cellular clock as it can repeatedly insert, delete, or mutate loci in a predetermined way with insertions being particularly valuable as repeated, regular insertions can be made at any target genomic locus.

Another important application related to recording cellular signals is the parallel recording of a large number of cellular inputs. Linking cellular signaling events to DNA modification enables recording of whether such a signaling event has occurred. Similar to Cas9 nuclease-based or base editing-based recording systems, recording of cellular events can be tethered to gRNA or editor expression. Unlike these other approaches, lineage prime editing should be able to record the order, intensity, and duration of signaling events without requiring strict sequence motifs for ordered editing. Indeed, lineage prime editing should be able to integrate the cellular counter described above with signal specific insertions, deletions, or mutations to study the order, intensity, and duration of biological signals. Due to the programmable nature of prime editing, this approach can be achieved at genomic loci pre-existing in the target cell of interest (whether this is in bacteria, mice, rats, monkeys, pigs, humans, zebrafish, *C. elegans*, etc.). It is important to note as well that prime editing recording installs barcodes in a guide RNA dependent manner, the number of inputs is limited to the number of signals for which there are reliable signal specific guide RNA expression cassettes (which should be very high due to the ability to tether these expressions to the activity of RNA Pol II promoters). The number of recordable signals scales linearly with the number of PEgRNAs needed.

PE can also be used to trace cellular lineages. Repeated sequence modification can be used to generate unique cellular barcodes to track individual cells. The arrays of barcodes, their order, and size can all be used to infer cellular lineages in a way that can be complementary to the large number of indel states generated by Cas9 nuclease.

Prime Editing Methodology for Repeated Sequence Modification

A number of distinct modalities for repeated sequence modification using prime editing (PE) were envisioned: DNA mutagenesis; sequence deletion; and, sequence insertion. Notably, these applications can be used on either pre-existing genomic DNA targets or on pre-designed DNA sequences that researchers integrate into target cells. These techniques of serial sequence modification have value for recording information and for designed or stochastic modification of target loci in a continuous manner. Serial targeted locus modification may be particularly useful for generating libraries of variants in various hosts.

Repeated sequence mutation can be used to alter either genomic DNA or pre-designed integrated DNA sequences in an iterative manner to report on cellular signaling events. In this paradigm, mutations installed by PE gRNA activity will correspond to the presence of a cellular signal. These point mutations could install PAM motifs necessary for serial editing events, as well as point mutations that correspond to the presence of specific signals. This system would require gRNA design prior to use as each successive guide RNA will use a novel protospacer; however, it could be especially powerful for examining individual or small numbers of stimuli of particular interest. Installation of these mutations could be dependent on individual biological stimuli or could be connected to consistent cellular processes that would mark cellular time. The sequences below correspond to SEQ ID NOs: 743, 744, 744, and 745.

```
Target genomic DNA sequence
CGTATCGGTAACTGATCCGATGGAAAGCCAGTTCAGAACCG

Target sequence post edit #1 (install G and T)
CGTATCGGTAACTGATCCGATGGAATGCCAGGICAGAACCG Target sequence post edit #1 (use AGG PAM)
CGTATCGGTAACTGATCCGATGGAAT GCCAGGTCAGAACCG Target sequence post edit #2 (install G and A)
CGTATCGGTAACTGATCCGATGGAVGCCAGGAATGCCAGGTCAAAACGG
```

Another similar PE guide RNA-intensive method is the repeated deletion of target sequences. Removal of individual sequences from a target locus would allow for the ability to reconstruct signaling events through the loss of DNA motifs. Design of PEgRNAs that delete successive sequences would enable the tracking of consecutive signals. This would allow researchers to identify instances where one signal followed another, which would allow researchers to probe which signaling events happen in which order. Such a system has been tested using CAMERA; however, this required pre-selection of particular loci with unique sequence requirements. Successive sequence deletion using PE would allow for the paralleled recording of pairwise events in individual cells as no specific sequence determinants are required. This would allow researchers the ability to probe pairwise signaling events in a multiplexed manner inside any target cell of interest. The sequences below correspond to SEQ ID NOs: 746, 747, and 748.

```
Example target DNA sequence
CGTATCGGTAACTGATCCGATGGAAAGCCAGTTCAGAACCG

Target sequence post edit #1 (delete AAA)
CGTATCGGTAACTGATCCGATGGGCCAGTTCAGAACCG Target sequence post edit #2 (delete GCC)
CGTATCGGTAACTGATCCGATGGAGTTCAGAACCG
```

Sequence insertion is a third approach for the tracking cellular signaling events. Some variants of this strategy are less PEgRNA-dependent than mutagenesis or deletion. A number of different insertion strategies exist-insertion of short sequences, insertion of protospacers, insertion of a protospacer and a barcode, insertion of novel homology sequences, and insertion of homology sequences with a barcode.

Insertion of short repetitive sequences is a way to incrementally increase the size of a target sequence to measure the passage of time in a cell. In this system insertion of 5 or more nucleotides of repetitive sequence can cause repeat expansion in connection to either the passage of time or the continued presence of a pre-determined stimulus. The locus-agnostic nature of lineage PE again enables paralleled tracking of multiple unique sequence expansions in connection with discrete biological signals. This should enable measuring of the intensity of multiple biological signals across cellular time in individual cells. The sequences below correspond to SEQ ID NOs: 749, 750, and 751.

```
Example target DNA sequence
genomic sequence-CGTATCGTATCGTATCGTATTGG-
genomic sequence Target sequence post edit #1 (install CGTAT)
genomic sequence-CGTATCGTATCGTATCGTATCGTATTGG-
genomic sequence Target sequence post edit #2 (install CGTAT)
genomic sequence-CGTATCGTATCGTATCGTATCGTATTGG-
genomic sequence
```

Insertion of different short sequences would require a handful of PEgRNAs in a manner similar to the deletional space. The number of signals being recorded and the size of the inserted sequence would determine the number of combinations of PEgRNAs needed. One challenge with recording multiple sequences in this system would be the different efficiencies of each PEgRNA at inserting its cargo sequence.

Insertion of protospacers as indicators of cellular signals is enticing though technical challenges may infringe on the efficiency of this approach. Single PEgRNA systems will be challenging to use because PEgRNA cassettes would be substrates for themselves, causing insertions into the PEgRNA that compromise the efficiency and fidelity of successive edits. This same problem persists for two or three PEgRNA systems, as each guide is a substrate for another, enabling insertion of other sequences into the guide cassette itself, which could lead to inappropriate insertion of protospacer sequences in connection with the wrong signal. These protospacer insertion systems are also difficult to imagine with the inclusion of barcode sequences. Single PEgRNA barcode systems would simply write over the barcodes used, removing the data stored in the first edit. Multiple guide systems again suffer from insertions into other PEgRNA expression constructs, limiting its utility (especially in vivo). The sequences in FIG. 90 top to bottom, left to right correspond to SEQ ID NOs: 752, 752, 753, 754, 754, 755, and 756.

Insertion of homology sequences (i.e., sequences 3' of the Cas9 nick location), and especially homology sequences with associated barcodes, appear to be particularly useful lineage PE strategies. This system avoids the issues associated with protospacer insertion by ensuring that successive rounds of editing result in the insertion of a barcode from a PEgRNA cassette that cannot be modified by other PEgRNA editing events in the same cell. The barcoding system is valuable as multiple barcodes can be associated with a given stimulus. This system preserves the majority of the target protospacer but alters the seed sequence, PAM, and downstream adjacent nucleotides. This enables multiple signals to be connected to one editing locus without significant re-designing of the PEgRNAs being used. This strategy would enable multiplexed barcode insertion in response to a large number of cellular stimuli (either internal or external) at a single locus. It could enable recording of intensity, duration, and order of as many signals as there exist unique barcodes (which can be designed with multiple N nucleotides to generate 4^N possible barcodes; i.e. a 5-nt barcode would enable recording of 4^5 or 1024 unique signals at once). This system could be used both in vitro and in vivo.

References Cited in Example 13

Each of the following references are incorporated herein by reference.
1. Recording development with single cell dynamic lineage tracing. Aaron McKenna, James A. Gagnon.
2. Whole-organism lineage tracing by combinatorial and cumulative genome editing. Mckenna et al. Science. 2016 Jul. 29; 353(6298):aaf7907. doi10.1126/science.aaf7907. Epub 2016 May 26.
3. Molecular recording of mammalian embryogenesis. Chan et al. 2019. *Nature. June;* 570(7759):77-82. doi: 10.1038/s41586-019-1184-5. Epub 2019 May 13.

Example 14—Modulating Biomolecule Activity and/or Localization by PE

The subcellular localization and modification states of biomolecules regulate their activities. Specific biological functions like transcriptional control, cellular metabolism, and signal transduction cascades are all carefully orchestrated in particular locations within the cell. As such, modulating the cellular localization and modification states of proteins represents a potential therapeutic strategy for the treatment of disease. Some existing therapeutics have been developed to alter the localization of target proteins. For example, farnesylation inhibitors are designed to prevent lipidation and membrane targeting of important oncogenic proteins like KRAS. Similarly, small-molecule-induced ubiquitination of target proteins directs them to the proteasome for degradation. The ability to traffic proteins to these and other unique cellular compartments provides an opportunity to alter a number of biological processes. It is proposed herein that the use of prime editing (PE) to install genetically encoded handles for altering the modification state and the subcellular trafficking of biomolecules with a genetically encoded signal (e.g. proteins, lipids, sugars, and nucleic acids) for the purposes of therapeutics.

PE is a genome editing technology that enables the installation, deletion, or replacement of short DNA sequences into any genomic locus targetable with a Cas9 enzyme. Using this technology, one could in principle install or remove important DNA, RNA, or protein coding sequences that change the activities of these important biomolecules. More specifically, prime editing could be used to install motifs, or signals, that change the localization or modification properties of biomolecules. Some examples include modification to: protein amino acid sequences; motifs for post translational modifications; RNA motifs that change folding or localization; and, installation of DNA sequences that change the local chromatin state or architecture of the surrounding DNA.

One target biomolecule for PE-mediated modification is DNA. Modifications to DNA could be made to install a number of DNA sequences that change the accessibility of the target locus. Chromatin accessibility controls gene transcriptional output. Installation of marks to recruit chromatin compacting enzymes should decrease the transcriptional output of neighboring genes, while installation of sequences associated with chromatin opening should make regions more accessible and in turn increase transcription. Installation of more complex sequence motifs that mirror native regulatory sequences should provide more nuanced and biologically sensitive control than the currently available dCas9 fusions to different epigenetic reader, writer, or eraser enzymes—tools that typically install large numbers of a single type of mark that may not have a particular biological antecedent. Installation of sequences that will bring two loci into close proximity, or bring loci into contact with the nuclear membrane, should also alter the transcriptional output of those loci as has been demonstrated in the burgeoning field of 3-D genomic architecture.

Modifications to RNAs can also be made to alter their activity by changing their cellular localization, interacting partners, structural dynamics, or thermodynamics of folding. Installation of motifs that will cause translational pausing or frameshifting could change the abundance of mRNA species through various mRNA processing mechanisms. Modifying consensus splice sequences would also alter the abundance and prevalence of different RNA species. Changing the relative ratio of different splice isoforms would predictably lead to a change in the ratio of protein translation products, and this could be used to alter many biological pathways. For instance, shifting the balance of mitochondrial versus nuclear DNA repair proteins would alter the resilience of different cancers to chemotherapeutic reagents. Furthermore, RNAs could be modified with sequences that enable binding to novel protein targets. A number of RNA aptamers have been developed that bind with high affinity to cellular proteins. Installation of one of these aptamers could be used to either sequester different RNA species through binding to a protein target that will prevent their translation, biological activity, or to bring RNA species to specific subcellular compartments. Biomolecule degradation is another class of localization modification. For example, RNA methylation is used to regulate RNAs within the cell. Consensus motifs for methylation could be introduced into target RNA coding sequences with PE. RNAs could also be modified to include sequences that direct nonsense mediated decay machinery or other nucleic acid metabolism pathways to degrade the target RNA species would change the pool of RNAs in a cell. Additionally, RNA species could be modified to alter their aggregation state. Sequences could be installed on single RNAs of interest or multiple RNAs to generate RNA tangles that would render them ineffective substrates for translation or signaling.

Modifications to proteins via post-translational modification (PTM) also represent an important class of biomolecule manipulation that can be carried out with PE. As with RNA species, changing the abundance of proteins in a cell is an important capability of PE. Editing can be done to install stop codons in an open reading frame—this will eliminate full-length product from being produced by the edited DNA sequence. Alternatively, peptide motifs can be installed that cause the rate of protein degradation to be altered for a target protein. Installation of degradation tags into a gene body could be used to alter the abundance of a protein in a cell. Moreover, introduction of degrons that are induced by small molecules could enable temporal control over protein degradation. This could have important implications for both research and therapeutics as researchers could readily assess whether small molecule-mediated therapeutic protein degradation of a given target was a viable therapeutic strategy. Protein motifs could also be installed to change the subcellular localization of a protein. Amino acid motifs can be installed to preferentially traffic proteins to a number of subcellular compartments including the nucleus, mitochondria, cell membrane, peroxisome, lysosome, proteasome, exosome, and others.

Installing or destroying motifs modified by PTM machinery can alter protein post-translational modifications. Phosphorylation, ubiquitylation, glycosylation, lipidation (e.g. farnesylation, myristoylation, palmitoylation, prenylation, GPI anchors), hydroxylation, methylation, acetylation, crotonylation, SUMOylation, disulfide bond formations, side chain bond cleavage events, polypeptide backbone cleavage events (proteolysis), and a number of other protein PTMs have been identified. These PTMs change protein function, often by changing subcellular localization. Indeed, kinases often activate downstream signaling cascades via phosphorylation events. Removal of the target phosphosite would prevent signal transduction. The ability to site-specifically ablate or install any PTM motif while retaining full-length protein expression would be an important advance for both basic research and therapeutics. The sequence installation scope and target window of PE make it well suited for broad PTM modification space.

Removal of lipidation sites should prevent the trafficking of proteins to cell membranes. A major limitation to current therapeutics that target post-translational modification processes is their specificity. Farnesyl transferase inhibitors have been tested extensively for their ability to eliminate KRAS localization at cell membranes. Unfortunately, global inhibition of farnesylation comes with numerous off target effects that have prevented broad use of these small molecules. Similarly, specific inhibition of protein kinases with small molecules can be very challenging due to the large size of the human genome and similarities between various kinases. PE offers a potential solution to this specificity problem, as it enables inhibition of modification of the target protein by ablation of the modification site instead of global enzyme inhibition. For example, removal of the lipidated peptide motif in KRAS would be a targeted approach that could be used in place of farnesyl transferase inhibition. This approach is the functional inverse of inhibiting a target protein activity by installing a lipid-targeting motif on a protein not designed to be membrane bound.

PE can also be used to instigate protein-protein complexation events. Proteins often function within complexes to execute their biological activity. PE can be used to either create or destroy the ability of proteins to exist within these complexes. To eliminate complex formation events, amino acid substitutions or insertions along the protein: protein interface could be installed to disfavor complexation. SSX18 is a protein component of the BAF complex, an important histone-remodeling complex. Mutations in SSX18 drive synovial sarcomas. PE could be used to install side chains that prevent SSX18 from binding to its protein partners in the complex to prevent its oncogenic activity. PE could also be used to remove the pathogenic mutations to restore WT activity of this protein. Alternatively, PE could be used to keep proteins within either their native complex or to drag them to participate in interactions that are unrelated to their native activity to inhibit their activity. Forming complexes that maintain one interaction state over another could represent an important therapeutic modality. Altering protein: protein interfaces to decrease the Kd of the interaction would keep those proteins stuck to one another longer. As protein complexes can have multiple signaling complexes, like n-myc driving neuroblastoma signaling cascades in disease but otherwise participating in healthy transcriptional control in other cells. PE could be used to install mutations that drive n-myc association with healthy interactions partners and decrease its affinity for oncogenic interaction partners.

References Cited in Example 14

Each of the following references are incorporated herein by reference.
1. Selective Target Protein Degradation via Phthalimide Conjugation. Winter et al. Science. Author manuscript; available in PMC 2016 Jul. 8.
2. Reversible disruption of mSWI/SNF (BAF) complexes by the SS18-SSX oncogenic fusion in synovial sarcoma. Kadoch and Crabtree. Cell. 2013 Mar. 28; 153(1):71-85. doi: 10.1016/j.cell.2013.02.036.
3. Ribosomal frameshifting and transcriptional slippage: From genetic steganography and cryptography to adventitious use. Atkins et al. Nucleic Acids Research, Volume 44, Issue 15, 6 Sep. 2016, Pages 7007-7078.
4. Transcriptional Regulation and its Misregulation in Disease. Lee and Young. Cell. Author manuscript; available in PMC 2014 Mar. 14.
5. Protein localization in disease and therapy. Mien-Chie Hung, Wolfgang Link Journal of Cell Science 2011 124: 3381-3392.
6. Loss of post-translational modification sites in disease. Li et al. Pac Symp Biocomput. 2010:337-47. PTMD: A Database of Human Disease-associated Post-translational Modifications. Xu et al. Genomics Proteomics Bioinformatics. 2018 August; 16(4):244-251. Epub 2018 Sep. 21.
7. Post-transcriptional gene regulation by mRNA modifications. Zhao et al. Nature Reviews Molecular Cell Biology volume 18, pages 31-42 (2017).

Example 15—Design and Engineering of PEgRNAS

Described herein is a series of PEgRNA designs and strategies that can improve prime editing (PE) efficiency.

Prime editing (PE) is a genome editing technology that can replace, insert, or remove defined DNA sequences within a targeted genetic locus using information encoded within a prime editing guide RNA (PEgRNA). Prime editors (PEs) consist of a sequence-programmable DNA binding protein with nuclease activity (Cas9) fused to a reverse transcriptase (RT) enzyme. PEs form complexes with PEgR-NAs, which contain the information for targeting specific DNA loci within their spacer sequences, as well as information specifying the desired edit in an engineered extension built into a standard sgRNA scaffold. PE:PEgRNA complexes bind and nick the programmed target DNA locus, allowing hybridization of the nicked DNA strand to the engineered primer binding sequence (PBS) of the PEgRNA. The reverse transcriptase domain then copies the edit-encoding information within the RT template portion of the PEgRNA, using the nicked genomic DNA as a primer for DNA polymerization. Subsequent DNA repair processes incorporate the newly synthesized edited DNA strand into the genomic locus. While the versatility of prime editing holds great promise as a research tool and potential therapeutic, several limitations in efficiency and scope exist due to the multi-step process required for editing. For example, unfavorable RNA structures that form within the PEgRNA can inhibit the copying of DNA edits from the PEgRNA to the genomic locus. One potential way to improve PE technology is through redesign and engineering of the critical PEgRNA component. Improvements to the design of these PEgRNAs are likely to be necessary for improved PE efficiency, as well as enable installation of longer inserted sequences into the genome.

Described herein is a series of PEgRNA designs that are envisioned to improve the efficacy of PE. These designs take advantage of a number of previously published approaches for improving sgRNA efficacy and/or stability, as well as utilize a number of novel strategies. These improvements can belong to one or more of a number of different categories:

(1) Longer PEgRNAs. This category relations to improved designes that enable efficient expression of functional PEgRNAs from non-polymerase III (pol III) promoters, which would enable the expression of longer PEgRNAs without burdensome sequence requirements;

(2) Core improvements. This category relates to improvements to the core, Cas9-binding PEgRNA scaffold, which could improve efficacy;

(3) RT processivity. This category relates to modifications to the PEgRNA that improve RT processivity, enabling the insertion of longer sequences at targeted genomic loci; and (4) Termini motifs. This category relates to the addition of RNA motifs to the 5' and/or 3' termini of the PEgRNA that improve PEgRNA stability, enhance RT processivity, prevent mis-folding of the PEgRNA, or recruit additional factors important for genome editing.

Described herein are a number of potential such PEgRNA designs in each category. Several of these designs have been previously described for improving sgRNA activity with Cas9 and are indicated as such. Described herein is also a platform for the evolution of PEgRNAs for given sequence targets that would enable the polishing of the PEgRNA scaffold and enhance PE activity (5). Notably, these designs could also be readily applied to improve PEgRNAs recognized by any Cas9 or evolved variant thereof.

(1) Longer PEgRNAs.

sgRNAs are typically expressed from the U6 snRNA promoter. This promoter recruits pol III to express the associated RNA and is useful for expression of short RNAs that are retained within the nucleus. However, pol III is not highly processive and is unable to express RNAs longer than a few hundred nucleotides in length at the levels required for efficient genome editing[183]. Additionally, pol III can stall or terminate at stretches of U's, potentially limiting the sequence diversity that could be inserted using a PEgRNA. Other promoters that recruit polymerase II (such as pCMV) or polymerase I (such as the U1 snRNA promoter) have been examined for their ability to express longer sgRNAs[183]. However, these promoters are typically partially transcribed, which would result in extra sequence 5' of the spacer in the expressed PEgRNA, which has been shown to result in markedly reduced Cas9:sgRNA activity in a site-dependent manner. Additionally, while pol III-transcribed PEgRNAs can simply terminate in a run of 6-7 U's, PEgRNAs transcribed from pol II or pol I would require a different termination signal. Often such signals also result in polyadenylation, which would result in undesired transport of the PEgRNA from the nucleus. Similarly, RNAs expressed from pol II promoters such as pCMV are typically 5'-capped, also resulting in their nuclear export.

Previously, Rinn and coworkers screened a variety of expression platforms for the production of long-noncoding RNA-(lncRNA) tagged sgRNAs[183]. These platforms include RNAs expressed from pCMV and that terminate in the ENE element from the MALAT1 ncRNA from humans[184], the PAN ENE element from KSHV[185], or the 3' box from U1 snRNA[186]. Notably, the MALAT1 ncRNA and PAN ENEs form triple helices protecting the polyA-tail[184, 187]. It is anticipated that, in addition to enabling expression of RNAs, these constructs could also enhance RNA stability (see section iv). Using the promoter from the U1 snRNA to enable expression of these longer sgRNAs[183] was also explored. It is anticipated that these expression systems will also enable the expression of longer PEgRNAs. In addition, a series of methods have been designed for the cleavage of the portion of the pol II promoter that would be transcribed as part of the PEgRNA, adding either a self-cleaving ribozyme such as the hammerhead[188], pistol[189], hatchet[189], hairpin[190], VS[191], twister[192], or twister sister[192] ribozymes, or other self-cleaving elements to process the transcribed guide, or a hairpin that is recognized by Csy4[193] and also leads to processing of the guide. Also, it is hypothesized that incorporation of multiple ENE motifs could lead to improved PEgRNA expression and stability, as previously demonstrated for the KSHV PAN RNA and element[185]. It is also anticipated that circularizing the PEgRNA in the form of a circular intronic RNA (ciRNA) could also lead to enhanced RNA expression and stability, as well as nuclear localization[194].

PEgRNA Expression Platform Consisting of pCMV, Csy4 Hairping, the PEgRNA, and MALAT1 ENE (SEQ ID NO: 757)
TAGTTATTAATAGTAATCAATTACGGGGTCATTAGTTCATAGCCCATATA

TGGAGTTCCGCGTTACATAACTTACGGTAAATGGCCCGCCTGGCTGACCG

CCCAACGACCCCCGCCCATTGACGTCAATAATGACGTATGTTCCCATAGT

AACGCCAATAGGGACTTTCCATTGACGTCAATGGGTGGAGTATTTACGGT

AAACTGCCCACTTGGCAGTACATCAAGTGTATCATATGCCAAGTACGCCC

CCTATTGACGTCAATGACGGTAAATGGCCCGCCTGGCATTATGCCCAGTA

CATGACCTTATGGGACTTTCCTACTTGGCAGTACATCTACGTATTAGTCA

```
TCGCTATTACCATGGTGATGCGGTTTTGGCAGTACATCAATGGGCGTGGA

TAGCGGTTTGACTCACGGGGATTTCCAAGTCTCCACCCCATTGACGTCAA

TGGGAGTTTGTTTTGGCACCAAAATCAACGGGACTTTCCAAAATGTCGTA

ACAACTCCGCCCCATTGACGCAAATGGGCGGTAGGCGTGTACGGTGGGAG

GTCTATATAAGCAGAGCTGGTTTAGTGAACCGTCAGATCGTTCACTGCCG

TATAGGCAGGGCCCAGACTGAGCACGTGAGTTTTAGAGCTAGAAATAGCA

AGTTAAAATAAGGCTAGTCCGTTATCAACTTGAAAAAGTGGGACCGAGTC

GGTCCTCTGCCATCAAAGCGTGCTCAGTCTGTTTTAGGGTCATGAAGGTT

TTTCTTTTCCTGAGAAAACAACACGTATTGTTTTCTCAGGTTTTGCTTTT

TGGCCTTTTTCTAGCTTAAAAAAAAAAAAAGCAAAAGATGCTGGTGGTTG

GCACTCCTGGTTTCCAGGACGGGGTTCAAATCCCTGCGGCGTCTTTGCTT

TGACT
```

PEgRNA Expression Platform Consisting of pCMV, Csy4 Hairping, the PEgRNA, and PAN ENE

```
                                    (SEQ ID NO: 758)
TAGTTATTAATAGTAATCAATTACGGGGTCATTAGTTCATAGCCCATATA

TGGAGTTCCGCGTTACATAACTTACGGTAAATGGCCCGCCTGGCTGACCG

CCCAACGACCCCCGCCCATTGACGTCAATAATGACGTATGTTCCCATAGT

AACGCCAATAGGGACTTTCCATTGACGTCAATGGGTGGAGTATTTACGGT

AAACTGCCCACTTGGCAGTACATCAAGTGTATCATATGCCAAGTACGCCC

CCTATTGACGTCAATGACGGTAAATGGCCCGCCTGGCATTATGCCCAGTA

CATGACCTTATGGGACTTTCCTACTTGGCAGTACATCTACGTATTAGTCA

TCGCTATTACCATGGTGATGCGGTTTTGGCAGTACATCAATGGGCGTGGA

TAGCGGTTTGACTCACGGGGATTTCCAAGTCTCCACCCCATTGACGTCAA

TGGGAGTTTGTTTTGGCACCAAAATCAACGGGACTTTCCAAAATGTCGTA

ACAACTCCGCCCCATTGACGCAAATGGGCGGTAGGCGTGTACGGTGGGAG

GTCTATATAAGCAGAGCTGGTTTAGTGAACCGTCAGATCGTTCACTGCCG

TATAGGCAGGGCCCAGACTGAGCACGTGAGTTTTAGAGCTAGAAATAGCA

AGTTAAAATAAGGCTAGTCCGTTATCAACTTGAAAAAGTGGGACCGAGTC

GGTCCTCTGCCATCAAAGCGTGCTCAGTCTGTTTTGTTTTGGCTGGGTTT

TTCCTTGTTCGCACCGGACACCTCCAGTGACCAGACGGCAAGGTTTTTAT

CCCAGTGTATATTGGAAAAACATGTTATACTTTTGACAATTTAACGTGCC

TAGAGCTCAAATTAAACTAATACCATAACGTAATGCAACTTACAACATAA

ATAAAGGTCAATGTTTAATCCATAAAAAAAAAAAAAAAAAAAA
```

PEgRNA Expression Platform Consisting of pCMV, Csy4 Hairping, the PEgRNA, and 3xPAN ENE

```
                                    (SEQ ID NO: 759)
TAGTTATTAATAGTAATCAATTACGGGGTCATTAGTTCATAGCCCATATA

TGGAGTTCCGCGTTACATAACTTACGGTAAATGGCCCGCCTGGCTGACCG

CCCAACGACCCCCGCCCATTGACGTCAATAATGACGTATGTTCCCATAGT

AACGCCAATAGGGACTTTCCATTGACGTCAATGGGTGGAGTATTTACGGT

AAACTGCCCACTTGGCAGTACATCAAGTGTATCATATGCCAAGTACGCCC

CCTATTGACGTCAATGACGGTAAATGGCCCGCCTGGCATTATGCCCAGTA

CATGACCTTATGGGACTTTCCTACTTGGCAGTACATCTACGTATTAGTCA

TCGCTATTACCATGGTGATGCGGTTTTGGCAGTACATCAATGGGCGTGGA

TAGCGGTTTGACTCACGGGGATTTCCAAGTCTCCACCCCATTGACGTCAA

TGGGAGTTTGTTTTGGCACCAAAATCAACGGGACTTTCCAAAATGTCGTA

ACAACTCCGCCCCATTGACGCAAATGGGCGGTAGGCGTGTACGGTGGGAG

GTCTATATAAGCAGAGCTGGTTTAGTGAACCGTCAGATCGTTCACTGCCG

TATAGGCAGGGCCCAGACTGAGCACGTGAGTTTTAGAGCTAGAAATAGCA

AGTTAAAATAAGGCTAGTCCGTTATCAACTTGAAAAAGTGGGACCGAGTC

GGTCCTCTGCCATCAAAGCGTGCTCAGTCTGTTTTGTTTGGCTGGGTTT

TTCCTTGTTCGCACCGGACACCTCCAGTGACCAGACGGCAAGGTTTTTAT

CCCAGTGTATATTGGAAAAACATGTTATACTTTTGACAATTTAACGTGCC

TAGAGCTCAAATTAAACTAATACCATAACGTAATGCAACTTACAACATAA

ATAAAGGTCAATGTTTAATCCATAAAAAAAAAAAAAAAAAAAACACACTG

TTTTGGCTGGGTTTTTCCTTGTTCGCACCGGACACCTCCAGTGACCAGAC

GGCAAGGTTTTTATCCCAGTGTATATTGGAAAAACATGTTATACTTTTGA

CAATTTAACGTGCCTAGAGCTCAAATTAAACTAATACCATAACGTAATGC

AACTTACAACATAAATAAAGGTCAATGTTTAATCCATAAAAAAAAAAAAA

AAAAAATCTCTCTGTTTTGGCTGGGTTTTTCCTTGTTCGCACCGGACACC

TCCAGTGACCAGACGGCAAGGTTTTTATCCCAGTGTATATTGGAAAAACA

TGTTATACTTTTGACAATTTAACGTGCCTAGAGCTCAAATTAAACTAATA

CCATAACGTAATGCAACTTACAACATAAATAAAGGTCAATGTTTAATCCA

TAAAAAAAAAAAAAAAAAA
```

PEgRNA Expression Platform Consisting of pCMV, Csy4 Hairping, the PEgRNA, and 3' Box

```
                                    (SEQ ID NO: 760)
TAGTTATTAATAGTAATCAATTACGGGGTCATTAGTTCATAGCCCATATA

TGGAGTTCCGCGTTACATAACTTACGGTAAATGGCCCGCCTGGCTGACCG

CCCAACGACCCCCGCCCATTGACGTCAATAATGACGTATGTTCCCATAGT

AACGCCAATAGGGACTTTCCATTGACGTCAATGGGTGGAGTATTTACGGT

AAACTGCCCACTTGGCAGTACATCAAGTGTATCATATGCCAAGTACGCCC

CCTATTGACGTCAATGACGGTAAATGGCCCGCCTGGCATTATGCCCAGTA

CATGACCTTATGGGACTTTCCTACTTGGCAGTACATCTACGTATTAGTCA

TCGCTATTACCATGGTGATGCGGTTTTGGCAGTACATCAATGGGCGTGGA

TAGCGGTTTGACTCACGGGGATTTCCAAGTCTCCACCCCATTGACGTCAA

TGGGAGTTTGTTTTGGCACCAAAATCAACGGGACTTTCCAAAATGTCGTA

ACAACTCCGCCCCATTGACGCAAATGGGCGGTAGGCGTGTACGGTGGGAG

GTCTATATAAGCAGAGCTGGTTTAGTGAACCGTCAGATCGTTCACTGCCG

TATAGGCAGGGCCCAGACTGAGCACGTGAGTTTTAGAGCTAGAAATAGCA
```

-continued

AGTTAAAATAAGGCTAGTCCGTTATCAACTTGAAAAAGTGGGACCGAGTC

GGTCCTCTGCCATCAAAGCGTGCTCAGTCTGTTTGTTTCAAAAGTAGACT

GTACGCTAAGGGTCATATCTTTTTTTGTTTGGTTTGTGTCTTGGTTGGCG

TCTTAAA

PEgRNA Expression Platform Consisting of pU1, Csy4 Hairping, the PEgRNA, and 3' Box (SEQ ID NO: 761)
CTAAGGACCAGCTTCTTTGGGAGAGAACAGACGCAGGGGCGGGAGGGAAA

AAGGGAGAGGCAGACGTCACTTCCCCTTGGCGGCTCTGGCAGCAGATTGG

TCGGTTGAGTGGCAGAAAGGCAGACGGGGACTGGGCAAGGCACTGTCGGT

GACATCACGGACAGGGCGACTTCTATGTAGATGAGGCAGCGCAGAGGCTG

CTGCTTCGCCACTTGCTGCTTCACCACGAAGGAGTTCCCGTGCCCTGGGA

GCGGGTTCAGGACCGCTGATCGGAAGTGAGAATCCCAGCTGTGTGTCAGG

GCTGGAAAGGGCTCGGGAGTGCGCGGGGCAAGTGACCGTGTGTGTAAAGA

GTGAGGCGTATGAGGCTGTGTCGGGGCAGAGGCCCAAGATCTCAGTTCAC

TGCCGTATAGGCAGGGCCCAGACTGAGCACGTGAGTTTTAGAGCTAGAAA

TAGCAAGTTAAAATAAGGCTAGTCCGTTATCAACTTGAAAAAGTGGGACC

GAGTCGGTCCTCTGCCATCAAAGCGTGCTCAGTCTGTTTCAGCAAGTTCA

GAGAAATCTGAACTTGCTGGATTTTTGGAGCAGGGAGATGGAATAGGAGC

TTGCTCCGTCCACTCCACGCATCGACCTGGTATTGCAGTACCTCCAGGAA

CGGTGCACCCACTTTCTGGAGTTTCAAAAGTAGACTGTACGCTAAGGGTC

ATATCTTTTTTGTTTGGTTTGTGTCTTGGTTGGCGTCTTAAA (2) Core Improvements.

The core, Cas9-binding PEgRNA scaffold can likely be improved to enhance PE activity. Several such approaches have already been demonstrated. For instance, the first pairing element of the scaffold (P1) contains a GTTTT-AAAAC (SEQ ID NO: 3939) pairing element. Such runs of Ts have been shown to result in pol III pausing and premature termination of the RNA transcript. Rational mutation of one of the T-A pairs to a G-C pair in this portion of P1 has been shown to enhance sgRNA activity, suggesting this approach would also be feasible for PEgRNAs[195]. Additionally, increasing the length of P1 has also been shown to enhance sgRNA folding and lead to improved activity[195], suggesting it as another avenue for the improvement of PEgRNA activity. Finally, it is likely the polishing of the PEgRNA scaffold through directed evolution of PEgRNAs on a given DNA target would also result in improved activity. This is described in section (v).

PEgRNA Containing a 6 nt Extension to P1

(SEQ ID NO: 228)
GGCCCAGACTGAGCACGTGAGTTTTAGAGCTAGCTCATGAAAATGAGCTA

GCAAGTTAAAATAAGGCTAGTCCGTTATCAACTTGAAAAAGTGGGACCGA

GTCGGTCCTCTGCCATCAAAGCGTGCTCAGTCTGTTTTTTT

PEgRNA Containing a T-A to G-C Mutation within P1

(SEQ ID NO: 229)
GGCCCAGACTGAGCACGTGAGTTTGAGAGCTAGAAATAGCAAGTTTAAAT

AAGGCTAGTCCGTTATCAACTTGAAAAAGTGGGACCGAGTCGGTCCTCTG

CCATCAAAGCGTGCTCAGTCTGTTTTTTT (iii) Improvement of RT Processivity Via Modifications to the Template Region of the PEgRNA As the size of the insertion templated by the PEgRNA increases, it is more likely to be degraded by endonucleases, undergo spontaneous hydrolysis, or fold into secondary structures unable to be reverse-transcribed by the RT or that disrupt folding of the PEgRNA scaffold and subsequent Cas9-RT binding. Accordingly, it is likely that modification to the template of the PEgRNA might be necessary to affect large insertions, such as the insertion of whole genes. Some strategies to do so include the incorporation of modified nucleotides within a synthetic or semi-synthetic PEgRNA that render the RNA more resistant to degradation or hydrolysis or less likely to adopt inhibitory secondary structures[196]. Such modifications could include 8-aza-7-deaz-aguanosine, which would reduce RNA secondary structure in G-rich sequences; locked-nucleic acids (LNA) that reduce degradation and enhance certain kinds of RNA secondary structure; 2'-O-methyl, 2'-fluoro, or 2'-O-methoxyethoxy modifications that enhance RNA stability. Such modifications could also be included elsewhere in the PEgRNA to enhance stability and activity. Alternatively or additionally, the template of the PEgRNA could be designed such that it both encodes for a desired protein product and is also more likely to adopt simple secondary structures that are able to be unfolded by the RT. Such simple structures would act as a thermodynamic sink, making it less likely that more complicated structures that would prevent reverse transcription would occur. Finally, one could also imagine splitting the template into two, separate PEgRNAs. In such a design, a PE would be used to initiate transcription and also recruit a separate template RNA to the targeted site via an RNA-binding protein fused to Cas9 or an RNA recognition element on the PEgRNA itself such as the MS2 aptamer. The RT could either directly bind to this separate template RNA, or initiate reverse transcription on the original PEgRNA before swapping to the second template. Such an approach could enable long insertions by both preventing mis-folding of the PEgRNA upon addition of the long template and also by not requiring dissociation of Cas9 from the genome for long insertions to occur, which could possibly be inhibiting PE-based long insertions.

(iv) Installation of Additional RNA Motifs at the 5' or 3' Termini

PEgRNA designs could also be improved via the installation of additional motifs at either end of the terminus of the RNA. Several such motifs—such as the PAN ENE from KSHV and the ENE from MALAT1 were discussed earlier in part (i)[184,185] as possible means to terminate expression of longer PEgRNAs from non-pol III promoters. These elements form RNA triple helices that engulf the polyA tail, resulting in their being retained within the nucleus[184,187]. However, by forming complex structures at the 3' terminus of the PEgRNA that occlude the terminal nucleotide, these structures would also likely help prevent exonuclease-mediated degradation of PEgRNAs. Other structural elements inserted at the 3' terminus could also enhance RNA stability, albeit without enabling termination from non-pol III promoters. Such motifs could include hairpins or RNA quadruplexes that would occlude the 3' terminus[197], or self-cleaving ribozymes such as HDV that would result in the formation of a 2'-3'-cyclic phosphate at the 3' terminus and also potentially render the PEgRNA less likely to be degraded by exonucleases[198]. Inducing the PEgRNA to cyclize via incomplete splicing—to form a ciRNA—could also increase PEgRNA stability and result in the PEgRNA being retained within the nucleus[194].

Additional RNA motifs could also improve RT processivity or enhance PEgRNA activity by enhancing RT binding to the DNA-RNA duplex. Addition of the native sequence bound by the RT in its cognate retroviral genome could enhance RT activity[199]. This could include the native primer binding site (PBS), polypurine tract (PPT), or kissing loops involved in retroviral genome dimerization and initiation of transcription[199]. Addition of dimerization motifs— such as kissing loops or a GNRA tetraloop/tetraloop receptor pair[200]—at the 5' and 3' termini of the PEgRNA could also result in effective circularization of the PEgRNA, improving stability. Additionally, it is envisioned that addition of these motifs could enable the physical separation of the PEgRNA spacer and primer, prevention occlusion of the spacer which would hinder PE activity. Short 5' extensions to the PEgRNA that form a small toehold hairpin in the spacer region could also compete favorably against the annealing region of the PEgRNA binding the spacer. Finally, kissing loops could also be used to recruit other template RNAs to the genomic site and enable swapping of RT activity from one RNA to the other (section iii).

PEgRNA-HDV Fusion (SEQ ID NO: 230)
GGCCCAGACTGAGCACGTGAGTTTTAGAGCTAGAAATAGCAAGTTAAAAT

AAGGCTAGTCCGTTATCAACTTGAAAAAGTGGGACCGAGTCGGTCCTCTG

CCATCAAAGCGTGCTCAGTCTGGGCCGGCATGGTCCCAGCCTCCTCGCTG

GCGCCGGCTGGGCAACATGCTTCGGCATGGCGAATGGGACTTTTTTT

PEgRNA-MMLV Kissing Loop (SEQ ID NO: 231)
GGTGGGAGACGTCCCACCGGCCCAGACTGAGCACGTGAGTTTTAGAGCTA

GAAATAGCAAGTTAAAATAAGGCTAGTCCGTTATCAACTTGAAAAAGTGG

GACCGAGTCGGTCCTCTGCCATCAAAGCTTCGACCGTGCTCAGTCTGGTG

GGAGACGTCCCACCTTTTTT

PEgRNA-VS Ribozyme Kissing Loop (SEQ ID NO: 232)
GAGCAGCATGGCGTCGCTGCTCACGGCCCAGACTGAGCACGTGAGTTTTA

GAGCTAGAAATAGCAAGTTAAAATAAGGCTAGTCCGTTATCAACTTGAAA

AAGTGGGACCGAGTCGGTCCTCTGCCATCAAAGCTTCGACCGTGCTCAGT

CTCCATCAGTTGACACCCTGAGGTTTTTT

PEgRNA-GNRA Tetraloop/Tetraloop Receptor (SEQ ID NO: 233)
GCAGACCTAAGTGGUGACATATGGTCTGGGCCCAGACTGAGCACGTGAGT -continued
TTTAGAGCTAUACGTAGCAAGTTAAAATAAGGCTAGTCCGTTATCAACTT

UACGAAGTGGGACCGAGTCGGTCCTCTGCCATCAAAGCTTCGACCGTGCT

CAGTCTGCATGCGATTAGAAATAATCGCATGTTTTTT

PEgRNA Template Switching Secondary RNA-HDV Fusion (SEQ ID NO: 234)
TCTGCCATCAAAGCTGCGACCGTGCTCAGTCTGGTGGGAGACGTCCCACC

GGCCGGCATGGTCCCAGCCTCCTCGCTGGCGCCGGCTGGGCAACATGCTT

CGGCATGGCGAATGGGACTTTTTTT (v) Evolution of PEgRNAs

It is likely that the PEgRNA scaffold can be further improved via directed evolution, in an analogous fashion to how SpCas9 and base editors have been improved[201]. Directed evolution could enhance PEgRNA recognition by Cas9 or evolved Cas9 variants. Additionally, it is likely that different PEgRNA scaffold sequences would be optimal at different genomic loci, either enhancing PE activity at the site in question, reducing off-target activities, or both. Finally, evolution of PEgRNA scaffolds to which other RNA motifs have been added would almost certainly improve the activity of the fused PEgRNA relative to the unevolved, fusion RNA. For instance, evolution of allosteric ribozymes composed of c-di-GMP-I aptamers and hammerhead ribozymes led to dramatically improved activity[202], suggesting that evolution would improve the activity of hammerhead-PEgRNA fusions as well. In addition, while Cas9 currently does not generally tolerate 5' extension of the sgRNA, directed evolution will likely generate enabling mutations that mitigate this intolerance, allowing additional RNA motifs to be utilized.

As described herein, a number of these approaches have already been described for use with Cas9:sgRNA complexes, but no designs for improving PEgRNA activity have been reported. Other strategies for the installation of programmable mutations into the genome include base-editing, homology-directed recombination (HDR), precise microhomology-mediated end-joining (MMEJ), or transposase-mediated editing. However, all of these approaches have significant drawbacks when compared to PEs. Current base editors, while more efficient than existing PEs, can only install certain classes of genomic mutations and can result in additional, undesired nucleotide conversions at the site of interest. HDR is only feasible in a very small minority of cell types and results in comparably high rates of random insertion and deletion mutations (indels). Precise MMEJ can lead to predictable repair of double-strand breaks, but is largely limited to installation of deletions, is very site-dependent, and can also have comparably high rates of undesired indels. Transposase-mediated editing has to date only been shown to function in bacteria. As such improvements to PE represent possibly the best path forward for the therapeutic correction of a wide-swatch of genomic mutations.

References Cited in Example 15

Each of the following references are cited in Example 15, each of which are incorporated herein by reference.
1. Schechner, D M, Hacisuleyman E., Younger S T, Rinn J L. Nat Methods 664-70 (2015).
2. Brown J A, et al. Nat Struct Mol Biol 633-40 (2014).

3. Conrad N A and Steitz J A. EMBO J 1831-41 (2005).
4. Bartlett J S, et al. Proc Natl Acad Sci USA 8852-7 (1996).
5. Mitton-Fry R M, DeGregorio S J, Wang J, Steitz T A, Steitz J A. Science 1244-7 (2010).
6. Forster A C, Symons R H. Cell. 1987.
7. Weinberg Z, Kim P B, Chen T H, Li S, Harris K A, Lünse C E, Breaker R R. Nat. Chem. Biol. 2015.
8. Feldstein P A, Buzayan J M, Bruening G. Gene 1989.
9. Saville B J, Collins R A. Cell. 1990.
10. Roth A, Weinberg Z, Chen A G, Kim P G, Ames T D, Breaker R R. Nat Chem Biol. 2013.
11. Borchardt E K, et al. RNA 1921-30 (2015).
12. Zhang Y, et al. Mol Cell 792-806 (2013).
13. Dang Y, et al. Genome Biol 280 (2015).
14. Schaefer M, Kapoor U, and Jantsch M F. Open Biol 170077 (2017).
15. Nahar S, et al. Chem Comm 2377-80 (2018).
16. Gao Y and Zhao Y. J Integr Plant Biol 343-9 (2014).
17. Dubois N, Marquet R, Paillart J, Bernacchi S. Front Microbiol 527 (2018).
18. Costa M and Michel F. EMBO J 1276-85 (1995).
19. Hu J H, et al. Nature 57-63 (2018).
20. Furukawa K, Gu H, Breaker R R. Methods Mol Biol 209-20 (2014).

Example 16—Expanding the Targeting Scope of PE Using DNA Binding Proteins Other than SpCas9

Prime editing (PE) using *Streptococcus pyogenes* Cas9 (SpCas9) can efficiently install all single base substitutions, insertions, deletions, and combinations thereof at genomic loci where there is a suitably-placed NGG protospacer adjacent motif (PAM) that SpCas9 can efficiently bind. The methods described herein broaden the targeting capability of PE by expanding the accessible PAMs and, therefore, the targetable genomic loci accessible for efficient PE. Prime editors using RNA-guided DNA binding proteins other than SpCas9 enable an expanded targettable scope of genomic loci by allowing access to different PAMs. In addition, use of RNA-guided DNA binding proteins smaller than SpCas9 also allows for more efficient viral delivery. PE with Cas proteins or other RNA-guided DNA binding proteins beyond SpCas9 will allow for high efficiency therapeutic edits that were either inaccessible or inefficient using SpCas9-based PE.

This is expected to be used in situations where SpCas9-based PE is either inefficient due to non-ideal spacing of an edit to relative to an NGG PAM or the overall size of the SpCas9-based construct is prohibitive for cellular expression and/or delivery. Specific disease-relevent loci such as the Huntingtin gene, which has few and poorly located NGG PAMs for SpCas9 near the target region, can easily be targeted using different Cas proteins in the PE system such as SpCas9-VRQR which recognizes an NGA PAM. Smaller Cas proteins will be used to generate smaller PE constructs that can be packaged into AAV vectors more efficiently, enabling better delivery to target tissues. FIG. 61 shows the reduction to practice of prime editing using *Staphylococcus aureus* CRISPR-Cas as the RNA-guided DNA binding protein. NT is untreated control.

FIGS. 62A-62B provide a demonstration of the importance of the protospacer for efficient installation of a desired edit at a precise location with prime editing. This highlights the importance of alternate PAMs and protospacers as novel features of this technology. "n.d." in FIG. 62A is "not detected."

FIG. 63 shows the reduction to practice of PE using SpCas9(H840A)-VRQR and SpCas9(H840A)-VRER as the RNA-guided DNA binding protein in a prime editor system. The SpCas9(H840A)-VRQR napDNAbp is disclosed herein as SEQ ID NO: 87. The SpCas9(H840A)-VRER napDNAbp is disclosed herein as SEQ ID NO: 88. The SpCas9(H840A)-VRER-MMLV RT fusion protein is disclosed herein as SEQ ID NO: 516, wherein the MMLV RT comprises the D200N, L603W, T330P, T306K, and W313F substitutions relative to the wild type MMLV RT. The SpCas9(H840A)-VRQR-MMLV RT fusion protein is disclosed herein as SEQ ID NO: 515, wherein the MMLV RT comprises the D200N, L603W, T330P, T306K, and W313F substitutions relative to the wild type MMLV RT. Seven different loci in the human genome are targeted: 4 with the SpCas9(H840A)-VRQR-MMLV RT prime editor system and 3 with the SpCas9(H840A)-VRER-MMLV RT system. The amino acid sequences of the tested contructs are as follows:

```
SACAS9-M-MLV      MKRTADGSEFESPKKKRKVGKRNYILGLDIGITSVGYGIIDYETR
RT PRIME EDITOR   DVIDAGVRLFKEANVENNEGRRSKRGARRLKRRRRHRIQRVKK
                  LLFDYNLLTDHSELSGINPYEARVKGLSQKLSEEEFSAALLHLA
                  KRRGVHNVNEVEEDTGNELSTKEQISRNSKALEEKYVAELQLE
                  RLKKDGEVRGSINRFKTSDYVKEAKQLLKVQKAYHQLDQSFID
                  TYIDLLETRRTYYEGPGEGSPFGWKDIKEWYEMLMGHCTYFPE
                  ELRSVKYAYNADLYNALNDLNNLVITRDENEKLEYYEKFQIIEN
                  VFKQKKKPTLKQIAKEILVNEEDIKGYRVTSTGKPEFTNLKVYH
                  DIKDITARKEIIENAELLDQIAKILTIYQSSEDIQEELTNLNSELTQE
                  EIEQISNLKGYTGTHNLSLKAINLILDELWHTNDNQIAIFNRLKL
                  VPKKVDLSQQKEIPTTLVDDFILSPVVKRSFIQSIKVINAIIKKYG
                  LPNDIIIELAREKNSKDAQKMINEMQKRNRQTNERIEEIIRTTGK
                  ENAKYLIEKIKLHDMQEGKCLYSLEAIPLEDLLNNPFNYEVDHII
                  PRSVSFDNSFNNKVLVKQEEASKKGNRTPFQYLSSSDSKISYETF
                  KKHILNLAKGKGRISKTKKEYLLEERDINRFSVQKDFINRNLVD
                  TRYATRGLMNLLRSYFRVNNLDVKVKSINGGFTSFLRRKWKFK
                  KERNKGYKHHAEDALIIANADFIFKEWKKLDKAKKVMENQMF
                  EEKQAESMPEIETEQEYKEIFITPHQIKHIKDFKDYKYSHRVDKK
                  PNRELINDTLYSTRKDDKGNTLIVNNLNGLYDKDNDKLKKLIN
                  KSPEKLLMYHHDPQTYQKLKLIMEQYGDEKNPLYKYYEETGN
                  YLTKYSKKDNGPVIKKIKYYGNKLNAHLDITDDYPNSRNKVVK
                  LSLKPYRFDVYLDNGVYKFVTVKNLDVIKKENYYEVNSKCYE
                  EAKKLKKISNQAEFIASFYNNDLIKINGELYRVIGVNNDLLNRIE
                  VNMIDITYREYLENMNDKRPPRIIKTIASKTQSIKKYSTDILGNL
                  YEVKSKKHPQIIKKGSGGSSGGSSGSETPGTSESATPESSGGSSG
                  GSSTLNIEDEYRLHETSKEPDVSLGSTWLSDFPQAWAETGGMGL
                  AVRQAPLIIPLKATSTPVSIKQYPMSQEARLGIKPHIQRLLDQGIL
                  VPCQSPWNTPLLPVKKPGTNDYRPVQDLREVNKRVEDIHPTVP
```

-continued

```
          NPYNLLSGLPPSHQWYTVLDLKDAFFCLRLHPTSQPLFAFEWR
          DPEMGISGQLTWTRLPQGFKNSPTLFDEALHRDLADFRIQHPDL
          ILLQYVDDLLLAATSELDCQQGTRALLQTLGNLGYRASAKKAQ
          ICQKQVKYLGYLLKEGQRWLTEARKETVMGQPTPKTPRQLREF
          LGTAGFCRLWIPGFAEMAAPLYPLTKTGTLFNWGPDQQKAYQEI
          KQALLTAPALGLPDLTKPFELFVDEKQGYAKGVLTQKLGPWRR
          PVAYLSKKLDPVAAGWPPCLRMVAAIAVLTKDAGKLTMGQPLVI
          LAPHAVEALVKQPPDRWLSNARMTHYQALLLDTDRVQFGPVV
          ALNPATLLPLPEEGLQHNCLDILAEAHGTRPDLTDQPLPDADHT
          WYTDGSSLLQEGQRKAGAAVTTETEVIWAKALPAGTSAQRAEL
          IALTQALKMAEGKKLNVYTDSRYAFATAHIHGEIYRRRGLLTSE
          GKEIKNKDEILALLKALFLPKRLSIIHCPGHQKGHSAEARGNRM
          ADQAARKAAITETPDTSTLLIENSSPSGGSKRTADGSEFEPKKKR
          KV (SEQ ID NO: 660)

SPC AS 9(H840A)-  MKRTADGSEFESPKKKRKVDKKYSIGLDIGTNSVGWAVITDEY
VRQR- MALONEY     KVPSKKFKVLGNTDRHSIKKNLIGALLFDSGETAEATRLKRTAR
MURINE            RRYTRRKNRICYLQEIFSNEMAKVDDSFFHRLEESFLVEEDKKH
LEUKEMIA VIRUS    ERHPIFGNIVDEVAYHEKYPTIYHLRKKLVDSTDKADLRLIYLAL
REVERSE           AHMIKFRGHFLIEGDLNPDNSDVDKLFIQLVQTYNQLFEENPIN
TRANSCRIPTASE     ASGVDAKAILSARLSKSRRLENLIAQLPGEKKNGLFGNLIALSL
PRIME EDITOR      GLTPNFKSNFDLAEDAKLQLSKDTYDDDLDNLLAQIGDQYADL
                  FLAAKNLSDAILLSDILRVNTEITKAPLSASMIKRYDEHHQDLTL
                  LKALVRQQLPEKYKEIFFDQSKNGYAGYIDGGASQEEFYKFIKPI
                  LEKMDGTEELLVKLNREDLLRKQRTFDNGSIPHQIHLGELHAIL
                  RRQEDFYPFLKDNREKIEKILTFRIPYYVGPLARGNSRFAWMTR
                  KSEETITPWNFEEVVDKGASAQSFIERMTNFDKNLPNEKVLPKH
                  SLLYEYFTVYNELTKVKYVTEGMRKPAFLSGEQKKAIVDLLFKT
                  NRKVTVKQLKEDYFKKIECFDSVEISGVEDRFNASLGTYHDLL
                  KIIKDKDFLDNEENEDILEDIVLTLTLFEDREMIEERLKTYAHLFD
                  DKVMKQLKRRRYTGWGRLSRKLINGIRDKQSGKTILDFLKSDG
                  FANRNFMQLIHDDSLTFKEDIQKAQVSGQGDSLHEHIANLAGSP
                  AIKKGILQTVKVVDELVKVMGRHKPENIVIEMARENQTTQKGQ
                  KNSRERMKRIEEGIKELGSQILKEHPVENTQLQNEKLYLYYLQN
                  GRDMYVDQELDINRLSDYDVDAIVPQSFLKDDSIDNKVLTRSD
                  KNRGKSDNVPSEEVVKKMKNYWRQLLNAKLITQRKFDNLTKA
                  ERGGLSELDKAGFIKRQLVETRQITKHVAQILDSRMNTKYDEND
                  KLIREVKVITLKSKLVSDFRKDFQFYKVREINNYHHAHDAYLNA
                  VVGTALIKKYPKLESEFVYGDYKVYDVRKMIAKSEQEIGKATA
                  KYFFYSNIMNFFKTEITLANGEIRKRPLIETNGETGEIVWDKGRD
                  FATVRKVLSMPQVNIVKKTEVQTGGFSKESILPKRNSDKLIARK
                  KDWDPKKYGGFVSPTVAYSVLVVAKVEKGKSKKLKSVKELLGI
                  TIEVIERSSFEKNPIDFLEAKGYKEVKKDLIIKLPKYSLFELENGRK
                  RMLASARELQKGNELALPSKYVNFLYLASHYEKLKGSPEDNEQ
                  KQLFVEQHKHYLDEIIEQISEFSKRVILADANLDKVLSAYNKHR
                  DKPIREQAENIIHLFTLTNLGAPAAFKYFDTTIDRKQYRSTKEVL
                  DATLIHQSITGLYETRIDLSQLGGDSGGSSGGSSGSETPGTSESAT
                  PESSGGSSGGSSTLNIEDEYRLHETSKEPDVSLGSTWLSDFPQA
                  WAETGGMGLAVRQAPLIIPLKATSTPVSIKQYPMSQEARLGIKP
                  HIQRLLDQGILVPCQSPWNTPLLPVKKPGTNDYRPVQDLREVN
                  KRVEDIHPTVPNPYNLLSGLPPSHQWYTVLDLKDAFFCLRLHPT
                  SQPLFAFEWRDPEMGISGQLTWTRLPQGFKNSPTLFNEALHRDL
                  ADFRIQHPDLILLQYVDDLLLAATSELDCQQGTRALLQTLGNLG
                  YRASAKKAQICQKQVKYLGYLLKEGQRWLTEARKETVMGQPT
                  PKTPRQLREFLGKAGFCRLFIPGFAEMAAPLYPLTKPGTLFNWG
                  PDQQKAYQEIKQALLTAPALGLPDLTKPFELFVDEKQGYAKGVL
                  TQKLGPWRRPVAYLSKKLDPVAAGWPPCLRMVAAIAVLTKDAG
                  KLTMGQPLVILAPHAVEALVKQPPDRWLSNARMTHYQALLLDT
                  DRVQFGPVVALNPATLLPLPEEGLQHNCLDILAEAHGTRPDLTD
                  QPLPDADHTWYTDGSSLLQEGQRKAGAAVTTETEVIWAKALPA
                  GTSAQRAELIALTQALKMAEGKKLNVYTDSRYAFATAHIHGEIY
                  RRRGWLTSEGKEIKNKDEILALLKALFLPKRLSIIHCPGHQKGHS
                  AEARGNRMADQAARKAAITETPDTSTLLIENSSPSGGSKRTADG
                  SEFEPKKKRKV (SEQ ID NO: 661)

SPC AS 9(H840A)-  MKRTADGSEFESPKKKRKVDKKYSIGLDIGTNSVGWAVITDEY
VRER-MALONEY      KVPSKKFKVLGNTDRHSIKKNLIGALLFDSGETAEATRLKRTAR
MURINE            RRYTRRKNRICYLQEIFSNEMAKVDDSFFHRLEESFLVEEDKKH
LEUKEMIA VIRUS    ERHPIFGNIVDEVAYHEKYPTIYHLRKKLVDSTDKADLRLIYLAL
REVERSE           AHMIKFRGHFLIEGDLNPDNSDVDKLFIQLVQTYNQLFEENPIN
TRANSCRIPTASE     ASGVDAKAILSARLSKSRRLENLIAQLPGEKKNGLFGNLIALSL
PRIME EDITOR      GLTPNFKSNFDLAEDAKLQLSKDTYDDDLDNLLAQIGDQYADL
                  FLAAKNLSDAILLSDILRVNTEITKAPLSASMIKRYDEHHQDLTL
                  LKALVRQQLPEKYKEIFFDQSKNGYAGYIDGGASQEEFYKFIKPI
                  LEKMDGTEELLVKLNREDLLRKQRTFDNGSIPHQIHLGELHAIL
                  RRQEDFYPFLKDNREKIEKILTFRIPYYVGPLARGNSRFAWMTR
                  KSEETITPWNFEEVVDKGASAQSFIERMTNFDKNLPNEKVLPKH
                  SLLYEYFTVYNELTKVKYVTEGMRKPAFLSGEQKKAIVDLLFKT
                  NRKVTVKQLKEDYFKKIECFDSVEISGVEDRFNASLGTYHDLL
                  KIIKDKDFLDNEENEDILEDIVLTLTLFEDREMIEERLKTYAHLFD
                  DKVMKQLKRRRYTGWGRLSRKLINGIRDKQSGKTILDFLKSDG
```

```
                    -continued
        FANRNFMQLIHDDSLTFKEDIQKAQVSGQGDSLHEHIANLAGSP
        AIKKGILQTVKVVDELVKVMGRHKPENIVIEMARENQTTQKGQ
        KNSRERMKRIEEGIKELGSQILKEHPVENTQLQNEKLYLYYLQN
        GRDMYVDQELDINRLSDYDVDAIVPQSFLKDDSIDNKVLTRSD
        KNRGKSDNVPSEEVVKKMKNYWRQLLNAKLITQRKFDNLTKA
        ERGGLSELDKAGFIKRQLVETRQITKHVAQILDSRMNTKYDEND
        KLIREVKVITLKSKLVSDFRKDFQFYKVREINNYHHAHDAYLNA
        VVGTALIKKYPKLESEFVYGDYKVYDVRKMIAKSEQEIGKATA
        KYFFYSNIMNFFKTEITLANGEIRKRPLIETNGETGEIVWDKGRD
        FATVRKVLSMPQVNIVKKTEVQTGGFSKESILPKRNSDKLIARK
        KDWDPKKYGGFVSPTVAYSVLVVAKVEKGKSKKLKSVKELLGI
        THVIERSSFEKNPIDFLEAKGYKEVKKDLIIKLPKYSLFELENGRK
        RMLASARELQKGNELALPSKYVNFLYLASHYEKLKGSPEDNEQ
        KQLFVEQHKHYLDEIIEQISEFSKRVILADANLDKVLSAYNKHR
        DKPIREQAENIIHLFTLTNLGAPAAFKYFDTTIDRKEYRSTKEVL
        DATLIHQSITGLYETRIDLSQLGGDSGGSSGGSSGSETPGTSESAT
        PESSGGSSGGSSTLNIEDEYRLHETSKEPDVSLGSTWLSDFPQA
        WAETGGMGLAVRQAPLIIPLKATSTPVSIKQYPMSQEARLGIKP
        HIQRLLDQGILVPCQSPWNTPLLPVKKPGTNDYRPVQDLREVN
        KRVEDIHPTVPNPYNLLSGLPPSHQWYTVLDLKDAFFCLRLHPT
        SQPLFAFEWRDPEMGISGQLTWTRLPQGFKNSPTLFNEALHRDL
        ADFRIQHPDLILLQYVDDLLLAATSELDCQQGTRALLQTLGNLG
        YRASAKKAQICQKQVKYLGYLLKEGQRWLTEARKETVMGQPT
        PKTPRQLREFLGKAGFCRLFIPGFAEMAAPLYPLTKPGTLFNWG
        PDQQKAYQEIKQALLTAPALGLPDLTKPFELFVDEKQGYAKGVL
        TQKLGPWRRPVAYLSKKLDPVAAGWPPCLRMVAAIAVLTKDAG
        KLTMGQPLVILAPHAVEALVKQPPDRWLSNARMTHYQALLLDT
        DRVQFGPVVALNPATLLPLPEEGLQHNCLDILAEAHGTRPDLTD
        QPLPDADHTWYTDGSSLLQEGQRKAGAAVTTETEVIWAKALPA
        GTSAQRAELIALTQALKMAEGKKLNVYTDSRYAFATAHIHGEIY
        RRRGWLTSEGKEIKNKDEILALLKALFLPKRLSIIHCPGHQKGHS
        AEARGNRMADQAARKAAITETPDTSTLLIENSSPSGGSKRTADG
        SEFEPKKKRKV (SEQ ID NO: 662)
```

As shown in FIG. 63, the SpCas9(H840A)-VRQR-MMLV RT was operational at PAM sites that included "AGAG" and "GGAG", with some editing activity at "GGAT" and "AGAT" PAM sequences. The SpCas9 (H840A)-VRER-MMLV RT was operational at PAM sites that included "AGCG" and "GGCG", with some editing activity at "TGCG."

The data demonstrates that prime editing may be conducted using napDNAbps which bear different PAM specificities, such as those Cas9 variant described herein.

Example 17—Introduction of Recombinase Target Sites with PE

This Example describes a method to address genetic disease or generate tailor-made animal or plant models by using prime editing (PE) to introduce recombinase targets sites (SSR target sites) in mammalian and other genomes with high specificity and efficiency.

This Example describes use of PE to introduce recombinase recognition sequences at high-value loci in human or other genomes, which, after exposure to site-specific recombinase(s), will direct precise and efficient genomic modifications (FIG. 64). In various embodiments show in FIG. 64, PE may be used to (b) insert a single SSR target for use as a site for genomic integration of a DNA donor template. (c) shows how a tandem insertion of SSR target sites can be used to delete a portion of the genome. (d) shows how a tandem insertion of SSR target sites can be used to invert a portion of the genome. (e) shows how the insertion of two SSR target sites at two distal chromosomal regions can result in chromosomal translocation. (f) shows how the insertion of two different SSR target sites in the genome can be used to exchange a cassette from a DNA donor template. Each of the types of genome modifications are envisioned by using PE to insert SSR targets, but this list also is not meant to be limiting.

Many large-scale genomic changes, such as gene insertions, deletions, inversions, or chromosomal translocations, are implicated in genetic disease[1-7]. In addition, custom and targeted manipulation of eukaryotic genomes is important for research into human disease, as well as generation of transgenic plants[8,9] or other biotechnological products. For example, microdeletions of chromosomes can lead to disease, and replacement of these deletions by insertions of critical DNA elements could lead to a permanent amelioration of disease. In addition, diseases resulting from inversions, gene copy number changes, or chromosomal translocations could be addressed by restoring the previous gene structure in affected cells. Alternatively, in plants or other high value eukaryotic organisms used in industry, introduction of recombinant DNA or targeted genomic rearrangements could lead to improved products, for example crops which require fewer resources or are resistant to pathogens. Current technologies for effecting large-scale genomic changes rely on random or stochastic processes, for example the use of transposons or retroviruses, while other desired genomic modifications have only been achieved by homologous recombination strategies.

One appealing class of proteins for accomplishing targeted and efficient genomic modification is site-specific recombinases (SSRs). SSRs have a long history of being used as a tool for genomic modification[10-13]. SSRs are considered promising tools for gene therapy because they catalyze the precise cleavage, strand exchange, and rejoining of DNA fragments at defined recombination targets[14] without relying on the endogenous repair of double-strand breaks which can induce indels, translocations, other DNA rearrangements, or p53 activation[15-18]. The reactions catalyzed by SSRs can result in the direct replacement, insertion, or deletion of target DNA fragments with efficiencies exceeding those of homology-directed repair[14,19].

Although SSRs offer many advantages, they are not widely used because they have a strong innate preference for their cognate target sequence. The recognition sequences of SSRs are typically ≥20 base pairs and thus unlikely to occur in the genomes of humans or model organisms. Further, the native substrate preferences of SSRs are not easily altered, even with extensive laboratory engineering or evolution[20]. This limitation is overcome by using PE to directly introduce recombinase targets into the genome, or to modify endogenous genomic sequences which natively resemble recombinase targets. Subsequent exposure of the cell to recombinase protein will permit precise and efficient genomic modification directed by the location and orientation of the recombinase target(s) (FIG. 64).

PE-mediated introduction of recombinase targets could be particularly useful for the treatment of genetic diseases which are caused by large-scale genomic defects, such as gene loss, inversion, or duplication, or chromosomal translocation[1-7] (Table 6). For example, Williams-Beuren syndrome is a developmental disorder caused by a deletion of 24 in chromosome 721. No technology exists currently for the efficient and targeted insertion of multiple entire genes in living cells (the potential of PE to do such a full-length gene insertion is currently being explored but has not yet been established); however, recombinase-mediated integration at a target inserted by PE offers one approach towards a permanent cure for this and other diseases. In addition, targeted introduction of recombinase recognition sequences could be highly enabling for applications including generation of transgenic plants, animal research models, bioproduction cell lines, or other custom eukaryotic cell lines. For example, recombinase-mediated genomic rearrangement in transgenic plants at PE-specific targets could overcome one of the bottlenecks to generating agricultural crops with improved properties[8,9].

A number of SSR family members have been characterized and their target sequences described, including natural and engineered tyrosine recombinases (TABLE 7), large serine integrases (TABLE 8), serine resolvases (TABLE 9), and tyrosine integrases (TABLE 10). Modified target sequences that demonstrate enhanced rates of genomic integration have also been described for several SSRs[22-30]. In addition to natural recombinases, programmable recombinases with distinct specificities have been developed[31-40]. Using PE, one or more of these recognition sequences could be introduced into the genome at a specified location, such as a safe harbor locus[41-43], depending on the desired application.

For example, introduction of a single recombinase target in the genome would result in integrative recombination with a DNA donor template (FIG. 64B). Serine integrases, which operate robustly in human cells, may be especially well-suited for gene integration[44,45]. Additionally, introduction of two recombinase targets could result in deletion of the intervening sequence, inversion of the intervening sequence, chromosomal translocation, or cassette exchange, depending on the identity and orientation of the targets (FIGS. 64C-64F). By choosing endogenous sequences that already closely resemble recombinase targets, the scope of editing required to introduce the complete recombinase target would be reduced.

Finally, several recombinases have been demonstrated to integrate into human or eukaryotic genomes at natively occurring pseudosites[46-64]. PE editing could be used to modify these loci to enhance rates of integration at these natural pseudosites, or alternatively, to eliminate pseudosites that may serve as unwanted off-target sequences.

This report describes a general methodology for introducing recombinase target sequences in eukaryotic genomes using PE, the applications of which are nearly limitless. The genome editing reactions are intended for use with "prime editor," a chimeric fusion of a CRISPR/Cas9 protein and a reverse-transcriptase domain, which utilizes a custom prime editing guide RNA (PEgRNA). By extension, Cas9 tools and homology-directed repair (HDR) pathways may also be exploited to introduce recombinase targets through DNA templates by lowering the rates of indels using several techniques[65-67]. A proof-of-concept experiment in human cell culture is shown in FIG. 65.

TABLE 6

Examples of genetic diseases linked to large-scale genomic modifications.

| Disease | Source | Cause |
| --- | --- | --- |
| Trisomy 17p | 68 | Gene duplication |
| Charcot-Marie-Tooth | 69 | Gene duplication |
| Smith-Magenis syndrome | 70 | Gene deletion |
| Williams-Beuren | 21 | Gene deletion |
| De la Chapelle syndrome | 71 | Chromosomal translocation |
| Down syndrome (some | 72 | Chromosomal translocation |
| Hemophilia A | 73 | Gene inversion |
| Hunter syndrome | 74 | Gene inversion |

TABLE 7

Tyrosine recombinases and SSR target sequences.

| cRecombinase | Source | Target | Name |
| --- | --- | --- | --- |
| Cre | 75 | ATAACTTCGTATAGCATACATTATACG AAGTTAT (SEQ ID NO: 517) | loxP |
| Dre | 76 | TAACTTTAAATAATGCCAATTATTTAA AGTTA (SEQ ID NO: 518) | rox |
| VCre | 77 | TCAATTTCTGAGAACTGTCATTCTCGG AAATTGA (SEQ ID NO: 519) | loxV |
| SCre | 77 | CTCGTGTCCGATAACTGTAATTATCGG ACATGAT (SEQ ID NO: 520) | loxS |
| Flp | 78 | GAAGTTCCTATTCTCTAGAAAGTATAG GAACTTC (SEQ ID NO: 521) | FRT |
| B2 | 79 | GAGTTTCATTAAGGAATAACTAATTCC CTAATGAAACTC (SEQ ID NO: 522) | loxB |

TABLE 7-continued

Tyrosine recombinases and SSR target sequences.

| cRecombinase | Source | Target | Name |
|---|---|---|---|
| B3 | 79 | GGTTGCTTAAGAATAAGTAATTCTTAA GCAACC (SEQ ID NO: 523) | loxB3 |
| Kw | 80 | ACGAAAAATGGTAAGGAATAGACCAT TCCTTACCATTTTTGGT (SEQ ID NO: 524) | |
| R | 81 | TTGATGAAAGAATAACGTATTCTTTCA TCAA (SEQ ID NO: 525) | RS |
| TD1-40 | 82 | GTGCGTCAAATAATAACGTATTATTTG ACACTT (SEQ ID NO: 526) | TDRS |
| Vika | 83 | AATAGGTCTGAGAACGCCCATTCTCAG ACGTATT (SEQ ID NO: 527) | vox |
| Nigri | 84 | TGAATGTCCTATAATTACACTTATAGG ACATTCA (SEQ ID NO: 528) | nox |
| Panto | 84 | GAAACTTTAAATAATAAGTCTTATTTA AAGTTTC (SEQ ID NO: 529) | pox |
| Kd | 79 | AAACGATATCAGACATTTGTCTGATA ATGCTTCATTATCAGACAAATGTCTG ATATCGTTT (SEQ ID NO: 530) | loxK |
| Fre | 85 | ATATATACGTATATAGACATATATACG TATATAT (SEQ ID NO: 531) | loxH |
| CreALSHG | 86 | ATAACTCTATATAATGTATGCTATATA GAGTTAT (SEQ ID NO: 532) | loxM7 |
| Tre | 87 | ACAACATCCTATTACACCCTATATGCC AACATGG (SEQ ID NO: 533) | loxLTR |
| Bred 1 | 12 | AACCCACTGCTTAAGCCTCAATAAAGC TTGCCTT (SEQ ID NO: 534) | loxBTR |
| Cre-R3M3 | 88 | GATACAACGTATATACCTTTCTATACG TTGTTTA (SEQ ID NO: 535) | loxK2 |

TABLE 8

Large serine integrases and SSR target sequences.

| Integrase | Source | Left Target | Right Target |
|---|---|---|---|
| Bxb1 | 89 | GGTTTGTCTGGTCAACCACC GCGGTCTCAGTGGTGTACGG TACAAACC (SEQ ID NO: 536) | GGCTTGTCGACGACGGCGG TCTCCGTCGTCAGGATCAT (SEQ ID NO: 537) |
| phiC31 | 90 | GTGCCCCAACTGGGGTAACC TTTGAGTTCTCTCAGTTGGG GG (SEQ ID NO: 538) | TGCGGGTGCCAGGGCGTGC CCTTGGGCTCCCCGGGCGCG TACTCC (SEQ ID NO: 539) |
| R4 | 91 | TGTTCCCCAAAGCGATACCA CTTGAAGCAGTGGTACTGCT TGTGGGTACA (SEQ ID NO: 540) | GCATGTTCCCCAAAGCGATA CCACTTGAAGCAGTGGTACT GCTTGTGGGTACACTCTGCG GGTG (SEQ ID NO: 541) |
| phiB T1 | 92 | GGTGCTGGGTTGTTGTCTCT GGACAGTGATCCATGGGAA ACTACTCAGCACC (SEQ ID NO: 542) | CAGGTTTTTGACGAAAGTGA TCCAGATGATCCAG (SEQ ID NO: 543) |
| MJ1 (phiFC1) | 93 | ATTTTAGGTATATGATTTTGT TTATTAGTGTAAATAACACT ATGTACCTAAAAT (SEQ ID NO: 544) | CAAAGGATCACTGAATCAA AAGTATTGCTCATCCACGCG AAA (SEQ ID NO: 545) |

TABLE 8-continued

Large serine integrases and SSR target sequences.

| Integrase | Source | Left Target | Right Target |
|---|---|---|---|
| MR11 | 94 | TTTGTGCGGAACTACGAACAGTTCATTAATACGAAGTGTACAAACTTCCATACAA (SEQ ID NO: 546) | CGAAAATGTATGGAGGCACTTGTATCAATATAGGATGTATACCTTCGAAGACACTT (SEQ ID NO: 547) |
| TP901-1 | 95 | GAGTTTTTATTTCGTTTATTTCAATTAAGGTAACTAAAAAACTCCTTTTAAGG (SEQ ID NO: 548) | ATGCCAACACAATTAACATCTCAATCAAGGTAAATGCTTTTTGCTTTTTTTGC (SEQ ID NO: 549) |
| A118 | 96 | TTCCTCGTTTTCTCTCGTTGGAAGAAGAAGAAACGAGAAA (SEQ ID NO: 550) | TTTCGGATCAAGCTATGAAGGACGCAAAGAGGGAACTAAA(SEQ ID NO: 551) |
| U153 | 97 | TTCCTCGTTTTCTCTCGTTGGACGGAAACGAATC (SEQ ID NO: 552) | TTTCGGATCAAGCTATGAAGGAGAAAGACGCAAAGAGGGAACTAAA (SEQ ID NO: 553) |
| phiRV1 | 98 | GTAGTGTATCTCACAGGTCCACGGTTGGCCGTGGACTGCTGAAGAACATTCC (SEQ ID NO: 554) | GAAGGTGTTGGTGCGGGGTTGGCCGTGGTCGAGGTGGGGT (SEQ ID NO: 555) |
| phi370.1 | 99 | AAAAAAATACAGCGTTTTTCATGTACAACTATACTAGTTGTAGTGCCTAAAA (SEQ ID NO: 556) | TTGTAAAGGAGACTGATAATGGCATGTACAACTATACTCGTCGGTAAAAAGGCA (SEQ ID NO: 557) |
| TG1 | 100 | TCCAGCCCAACAGTGTTAGTCTTTGCTCTTACCCAGTTGGGCGGGA (SEQ ID NO: 558) | GATCAGCTCCGCGGGCAAGACCTTTCTCCTTCACGGGGTGGAAGGTC (SEQ ID NO: 559) |
| WB | 101 | CTAGTTTTAAAGTTGGTTATTAGTTACTGTGATATTTATCACGGTACCCAATAACCAATGAAT (SEQ ID NO: 560) | CGGAAGGTAGCGTCAACGATAGGTGTAACTGTCGTGTTTGTAACGGTACTTCCAACAGCTGGCGCCGCCAC (SEQ ID NO: 561) |
| BL3 | 102 | CAATGAAAAACTAGGCATGTAGAAGTTGTTTGT (SEQ ID NO: 562) | TTTCCACAGACAACTCACGTGGAGGTAGTCAC (SEQ ID NO: 563) |
| SprA | 103 | TGTAGTAAGTATCTTAATATACAGCTTTATCTGTTTTTTAAGATACTTACTACTTT (SEQ ID NO: 564) | CACCCATTGTGTTCACAGGAGATACAGCTTTATCTGTACTGATATTAATGACATGCTG (SEQ ID NO: 565) |
| phiJoe | 104 | AGTTGTGGCCATGTGTCCATCTGGGGGCAGATGGAGACGGGGTCACA (SEQ ID NO: 566) | ATCTGGATGTGGGTGTCCATCTGCGGGCAGACGCCGCAGTCGAAGCACGG (SEQ ID NO: 567) |
| phiK38 | 105 | CCCTAATACGCAAGTCGATAACTCTCCTGGGAGCGTTGACAACTTGCGCACCCTGATCTG (SEQ ID NO: 569) | GAGCGCCGGATCAGGGAGTGGACGGCCTGGGAGCGCTACACGCTGTGGCTGCGGTCGGTGC (SEQ ID NO: 570) |
| Int2 | 105 | GCTCATGTATGTGTCTACGCGAGATTCTCGCCCGAGAACTTCTGCAAGGCACTGCTCTTGGCT (SEQ ID NO: 571) | GGACGGCGCAGAAGGGGAGTAGCTCTTCGCCGGACCGTCGACATACTGCTCAGCTCGTC (SEQ ID NO: 572) |
| Int3 | 105 | ATGGATAAAAAAATACAGCGTTTTTCATGTACAACTATACTAGTTGTAGTGCCTAAATAATGCTT (SEQ ID NO: 573) | GTTTGTAAAGGAGACTGATAATGGCATGTACAACTATACTCGTCGGTAAAAAGGCATCTTAT (SEQ ID NO: 574) |
| Int4 | 105 | AAAAATTACAAAGTTTTCAACCCTTGATTTGAATTAGCGGTCAAATAATTTGTAATTCGTTT (SEQ ID NO: 575) | TTCCAAAGAGCGCCCAACGCGACCTGAAATTTGAATAAGACTGCTGCTTGTGTAAAGGCGATGATT (SEQ ID NO: 576) |

TABLE 8-continued

Large serine integrases and SSR target sequences.

| Integrase | Source | Left Target | Right Target |
|---|---|---|---|
| Int7 | 105 | GTGTTATAAACCTGTGTGAGAGTTAAGTTTACATGCCTAACCTTAACTTTTACGCAGGTTCAGCTT (SEQ ID NO: 577) | AGACGAGAAACGTTCCGTCCGTCTGGGTCAGTTGGGCAAAGTTGATGACCGGGTCGTCCGTT (SEQ ID NO: 578) |
| Int8 | 105 | TTAATAAACTATGGAAGTATGTACAGTCTTGCAATGTTGAGTGAACAAACTTCCATAATAAAAT (SEQ ID NO: 579) | CAATCATCAGATAACTATGGCGGCACGTGCATTAACCACGGTTGTATCCCGTCTAAAGTACTCGT (SEQ ID NO: 580) |
| Int9 | 105 | GTGGTTGTTTTTGTTGGAAGTGTGTATCAGGTATCTGCATAGTTATTCCGAACTTCCAATTA (SEQ ID NO: 581) | TTTATATTGCGAAAAATAATTGGCGAACGAGGTAACTGGATACCTCATCCGCCAATTAAAATTTG (SEQ ID NO: 582) |
| Int10 | 105 | GGAAAATATAAATAATTTTAGTAACCTACATCTCAATCAAGGATAGTAAAACTCTCACTCTT (SEQ ID NO: 583) | AGCACGCTGATAATCAGCAAGACCACCAACATTTCCACCAATGTAAAAGCTTTAACCTTAGC (SEQ ID NO: 584) |
| Int11 | 105 | GTTTATATGTTTACTAATAAGACGCTCTCAACCCATAAAGTCTTATTAGTAAACATATTTCAACT (SEQ ID NO: 585) | ATGGATTTTGCAGATTCCAGATGCCCCTACAGAAAGAGGTACAAAACATTTATTGGAATTAATT (SEQ ID NO: 586) |
| Int12 | 105 | TTTTTGTATGTTAGTTGTGTCACTGGGTAGACCTAAATAGTGACACAACTGCTATTAAAATTTAA (SEQ ID NO: 587) | GTTCGTGGTAACTATGGGTGGTACAGGTGCCACATTAGTTGTACCATTTATGTTTATGTGGTTAAC (SEQ ID NO: 588) |
| Int13 | 105 | CAATAACGGTTGTATTTGTAGAACTTGACCAGTTGTTTTAGTAACATAAATACAACTCCGAATA (SEQ ID NO: 589) | GCATACATTGTTGTTGTTTTTCCAGATCCAGTTGGTCCTGTAAATATAAGCAATCCATGTGAGT (SEQ ID NO: 590) |
| LI | 106 | GTTTAGTATCTCGTTATCTCTCGTTGGAGGGAGAAGAAACGGGATACCAAAA (SEQ ID NO: 591) | TAACTTTTTCGGATCGAGTTATGATGACGTAAAGAGGGAACAAAGCATCTA (SEQ ID NO: 592) |
| Peaches | 107 | TAGTTTCCAATGTTACAGGAACTGCTGGCAGAATCCAACACATTGGAAGTCG (SEQ ID NO: 593) | CGGTCTCCATCGGGATCTGCTGATCGAGCAGCATGCCGACCA (SEQ ID NO: 594) |
| Bxz2 | 107 | TAACCGCAAGTGTACATCCCTCGGCTGGCCGAGACAAGTACAGTTGCGACAG (SEQ ID NO: 595) | CGGTCTCCATCGGGATCTGCTGATCGAGCAGCATGCCGACCA (SEQ ID NO: 596) |
| SV1 | 108 | ATGTGGTCCTTTAGATCCACTGACGTGGGTCAGTGTCTCTAAAGGACTCGCG (SEQ ID NO: 597) | CATCAGGGCGGTCAGGCCGTAGATGTGGAAGAAACGGCAGCACGGCGAGGACG (SEQ ID NO: 598) |

TABLE 9

Serine resolvases and SSR target sequences.

| Resolvase | Source | Left Target | Right Target |
|---|---|---|---|
| Gin | 109 | CGTTTCCTGTAAACCGAGGTTTTGGATAAACA (SEQ ID NO: 599) | CGTTTCCTGTAAACCGAGGTTTTGGATAATGG (SEQ ID NO: 600) |
| Cin | 110 | GAGTTCTCTTAAACCAAGGTTTAGGATTGAAA (SEQ ID NO: 601) | GAGTTCTCTTAAACCAAGGTATTGGATAACAG (SEQ ID NO: 602) |
| Hin | 111 | TGGTTCTTGAAAACCAAGGTTTTTGATAAAGC (SEQ ID NO: 603) | AAATTTTCCTTTTTGGAAGGTTTTTGATAACCA (SEQ ID NO: 604) |

TABLE 9-continued

Serine resolvases and SSR target sequences.

| Resolvase | Source | Left Target | Right Target |
|---|---|---|---|
| Min | 112 | GCCTTCCCCTAAACCAACGT TTTTATGCCGCC (SEQ ID NO: 605) | GCCTTCCCCCAAACCAAGGT AATCAAGAACGC (SEQ ID NO: 606) |
| Sin | 113 | TTGTGAAATTTGGGTACACC CTAATCATACAA (SEQ ID NO: 607) | CGTATGATTAGGGTGTATAT TAATTT (SEQ ID NO: 608) |

TABLE 10

Tyrosine integrases and target sequences.

| Integrase | Source | attP | attB |
|---|---|---|---|
| HK022 | 114 | CAAATGATTTTATTTTGACTAATAA TGACCTACTTACATTAATTTACTGAT AATTAAAGAGATTTTAAATATACAA CTTATTCACCTAAAGGATGACAAAA (SEQ ID NO: 609) | GCACTTTAGGTGA AAAAGGTT (SEQ ID NO: 610) |
| P22 | 115 | CTAAGTGGTTTGGGACAAAAATGGG ACATACAAATCTTTGCATCGGTTTG CAAGGCTTTGCATGTCTTTCGAAGA TGGGACGTGTGAGCGCAGGTATGAC GTGGTATGTGTTGACTTAAAAGGTA GTTCTTATAATTCGTAATGCGAAGG TCGTAGGTTCGACTCCTATTATCGG CACCAGTTAAATCAAATACTTACGT ATTATTCGTGCCTTCCTTATTTTTAC TGTGGGACATATTTGGGACAGAAGT ACCAAAAA (SEQ ID NO: 612) | GCAGCGCATTCGT AATGCGAAGGTCG T (SEQ ID NO: 613) |
| L5 | 116 | GCGATCCCCATCCGCGACGTGCCAA CTAGGTCTCCTCTCGTCGTGAACAA GGCTACCGGGTTGCAACTCCTGTGC AACTCTCAGGCTTCAACGCGCTTCT ACGACCTGCAATTTCTTTCCACTTA GAGGATGCAGCCGAGAGGGGTAAA AACCTATCTTGACCGGCCCATATGT GGTCGGCAGACACCCATTCTTCCAA ACTAGCTACGCGGGTTCGATTCCCG TCGCCCGCTCCGCTGGTCAGAGGGT GTTTTCGCCCTCTGGCCATTTTTCTT TCCAGGGGTCTGCAACTCTTGTGCG ACTCTTCTGACCTGGGCATACGCGG TTGCAACGCATCCCTGATCTGGCTA CTTTCGATGCTGACAAACGAATAGA GCCCCCCGCCTGCGCGAACAGACG AGGGGCATTCACA (SEQ ID NO: 614) | GAGCGGGCGACG GGAATCGAACCCG CGTAGCTAGTTTG GAAGA (SEQ ID NO: 615) |

References Cited in Example 17

Each of the following references are cited in Example 17, each of which are incorporated herein by reference.

1. Feuk, L. Inversion variants in the human genome: role in disease and genome architecture. Genome Med 2, 11 (2010).
2. Zhang, F., Gu, W., Hurles, M. E. & Lupski, J. R. Copy number variation in human health, disease, and evolution. Annu Rev Genomics Hum Genet 10, 451-481 (2009).
3. Shaw, C. J. & Lupski, J. R. Implications of human genome architecture for rearrangement-based disorders: the genomic basis of disease. Hum Mol Genet 13 Spec No 1, R57-64 (2004).
4. Carvalho, C. M., Zhang, F. & Lupski, J. R. Evolution in health and medicine Sackler colloquium: Genomic disorders: a window into human gene and genome evolution. Proc Natl Acad Sci USA 107 Suppl 1, 1765-1771 (2010).
5. Rowley, J. D. Chromosome translocations: dangerous liaisons revisited. Nat Rev Cancer 1, 245-250 (2001).
6. Aplan, P. D. Causes of oncogenic chromosomal translocation. Trends Genet 22, 46-55 (2006).
7. McCarroll, S. A. & Altshuler, D. M. Copy-number variation and association studies of human disease. Nat Genet 39, S37-42 (2007).
8. Wijnker, E. & de Jong, H. Managing meiotic recombination in plant breeding. Trends Plant Sci 13, 640-646 (2008).
9. Petolino, J. F., Srivastava, V. & Daniell, H. Editing Plant Genomes: a new era of crop improvement. Plant Biotechnol J 14, 435-436 (2016).

10. Smith, M. C. M. Phage-encoded Serine Integrases and Other Large Serine Recombinases. Microbiol Spectr 3 (2015).
11. Meinke, G., Bohm, A., Hauber, J., Pisabarro, M. T. & Buchholz, F. Cre Recombinase and Other Tyrosine Recombinases. Chem Rev 116, 12785-12820 (2016).
12. Karpinski, J. et al. Directed evolution of a recombinase that excises the provirus of most HIV-1 primary isolates with high specificity. Nat Biotechnol 34, 401-409 (2016).
13. Olorunniji, F. J., Rosser, S. J. & Stark, W. M. Site-specific recombinases: molecular machines for the Genetic Revolution. Biochem J 473, 673-684 (2016).
14. Grindley, N. D., Whiteson, K. L. & Rice, P. A. Mechanisms of site-specific recombination. Annu Rev Biochem 75, 567-605 (2006).
15. Lukacsovich, T., Yang, D. & Waldman, A.S. Repair of a specific double-strand break generated within a mammalian chromosome by yeast endonuclease I-SceI. Nucleic Acids Res 22, 5649-5657 (1994).
16. Rouet, P., Smih, F. & Jasin, M. Introduction of double-strand breaks into the genome of mouse cells by expression of a rare-cutting endonuclease. Mol Cell Biol 14, 8096-8106 (1994).
17. Jeggo, P. A. DNA breakage and repair. Adv Genet 38, 185-218 (1998).
18. Haapaniemi, E., Botla, S., Persson, J., Schmierer, B. & Taipale, J. CRISPR-Cas9 genome editing induces a p53-mediated DNA damage response. Nat Med 24, 927-930 (2018).
19. Wang, B. et al. Highly efficient CRISPR/HDR-mediated knock-in for mouse embryonic stem cells and zygotes. Biotechniques 59, 201-202, 204, 206-208 (2015).
20. Bogdanove, A. J., Bohm, A., Miller, J. C., Morgan, R. D. & Stoddard, B. L. Engineering altered protein-DNA recognition specificity. Nucleic Acids Res 46, 4845-4871 (2018).
21. Tassabehji, M. Williams-Beuren syndrome: a challenge for genotype-phenotype correlations. Hum Mol Genet 12 Spec No 2, R229-237 (2003).
22. Araki, K., Araki, M. & Yamamura, K. Targeted integration of DNA using mutant lox sites in embryonic stem cells. Nucleic Acids Res 25, 868-872 (1997).
23. Araki, K., Okada, Y., Araki, M. & Yamamura, K. Comparative analysis of right element mutant lox sites on recombination efficiency in embryonic stem cells. BMC Biotechnol 10, 29 (2010).
24. Thomson, J. G., Rucker, E. B., 3rd & Piedrahita, J. A. Mutational analysis of loxP sites for efficient Cre-mediated insertion into genomic DNA. Genesis 36, 162-167 (2003).
25. Jusiak, B. et al. Comparison of Integrases Identifies Bxb1-GA Mutant as the Most Efficient Site-Specific Integrase System in Mammalian Cells. ACS Synth Biol 8, 16-24 (2019).
26. Xie, F. et al. Adjusting the attB site in donor plasmid improves the efficiency of PhiC31 integrase system. DNA Cell Biol 31, 1335-1340 (2012).
27. Gupta, M., Till, R. & Smith, M. C. Sequences in attB that affect the ability of phiC31 integrase to synapse and to activate DNA cleavage. Nucleic Acids Res 35, 3407-3419 (2007).
28. Kolot, M., Malchin, N., Elias, A., Gritsenko, N. & Yagil, E. Site promiscuity of coliphage HK022 integrase as tool for gene therapy. Gene Ther 22, 602 (2015).
29. Gaj, T., Mercer, A. C., Sirk, S. J., Smith, H. L. & Barbas, C. F., 3rd A comprehensive approach to zinc-finger recombinase customization enables genomic targeting in human cells. Nucleic Acids Res 41, 3937-3946 (2013).
30. Chuang, K., Nguyen, E., Sergeev, Y. & Badea, T. C. Novel Heterotypic Rox Sites for Combinatorial Dre Recombination Strategies. G3 (Bethesda) 6, 559-571 (2015).
31. Chaikind, B., Bessen, J. L., Thompson, D. B., Hu, J. H. & Liu, D. R. A programmable Cas9-serine recombinase fusion protein that operates on DNA sequences in mammalian cells. Nucleic Acids Res 44, 9758-9770 (2016).
32. Gaj, T., Mercer, A. C., Gersbach, C. A., Gordley, R. M. & Barbas, C. F. Structure-guided reprogramming of serine recombinase DNA sequence specificity. P Natl Acad Sci USA 108, 498-503 (2011).
33. Gaj, T., Sirk, S. J. & Barbas, C. F., 3rd Expanding the scope of site-specific recombinases for genetic and metabolic engineering. Biotechnol Bioeng 111, 1-15 (2014).
34. Akopian, A., He, J., Boocock, M. R. & Stark, W. M. Chimeric recombinases with designed DNA sequence recognition. Proc Natl Acad Sci USA 100, 8688-8691 (2003).
35. Prorocic, M. M. et al. Zinc-finger recombinase activities in vitro. Nucleic Acids Research 39, 9316-9328 (2011).
36. Gersbach, C. A., Gaj, T., Gordley, R. M., Mercer, A. C. & Barbas, C. F. Targeted plasmid integration into the human genome by an engineered zinc-finger recombinase. Nucleic Acids Research 39, 7868-7878 (2011).
37. Sirk, S. J., Gaj, T., Jonsson, A., Mercer, A. C. & Barbas, C. F. Expanding the zinc-finger recombinase repertoire: directed evolution and mutational analysis of serine recombinase specificity determinants. Nucleic Acids Research 42, 4755-4766 (2014).
38. Gaj, T. & Barbas, C. F., 3rd Genome engineering with custom recombinases. Methods Enzymol 546, 79-91 (2014).
39. Olorunniji, F. J., Rosser, S. J. & Marshall Stark, W. Purification and In Vitro Characterization of Zinc Finger Recombinases. Methods Mol Biol 1642, 229-245 (2017).
40. Proudfoot, C., McPherson, A. L., Kolb, A. F. & Stark, W. M. Zinc finger recombinases with adaptable DNA sequence specificity. PLoS One 6, e19537 (2011).
41. Trion, S. et al. Identification and targeting of the ROSA26 locus in human embryonic stem cells. Nat Biotechnol 25, 1477-1482 (2007).
42. Sadelain, M., Papapetrou, E. P. & Bushman, F. D. Safe harbours for the integration of new DNA in the human genome. Nat Rev Cancer 12, 51-58 (2012).
43. Pellenz, S. et al. New human chromosomal safe harbor sites for genome engineering with CRISPR/Cas9, TAL effector and homing endonucleases. bioRxiv (2019).
44. Brown, W. R., Lee, N. C., Xu, Z. & Smith, M. C. Serine recombinases as tools for genome engineering. Methods 53, 372-379 (2011).
45. Xu, Z. et al. Accuracy and efficiency define Bxb1 integrase as the best of fifteen candidate serine recombinases for the integration of DNA into the human genome. BMC Biotechnol 13, 87 (2013).
46. Thyagarajan, B., Guimaraes, M. J., Groth, A. C. & Calos, M. P. Mammalian genomes contain active recombinase recognition sites. Gene 244, 47-54 (2000).
47. Shultz, J. L., Voziyanova, E., Konieczka, J. H. & Voziyanov, Y. A genome-wide analysis of FRT-like sequences in the human genome. PLoS One 6, e18077 (2011).
48. Thyagarajan, B., Olivares, E. C., Hollis, R. P., Ginsburg, D. S. & Calos, M. P. Site-specific genomic integration in mammalian cells mediated by phage phiC31 integrase. Mol Cell Biol 21, 3926-3934 (2001).
49. Sivalingam, J. et al. Biosafety assessment of site-directed transgene integration in human umbilical cord-lining cells. Mol Ther 18, 1346-1356 (2010).
50. Ortiz-Urda, S. et al. Stable nonviral genetic correction of inherited human skin disease. Nat Med 8, 1166-1170 (2002).
51. Chalberg, T. W. et al. Integration specificity of phage phiC31 integrase in the human genome. J Mol Biol 357, 28-48 (2006).
52. Thyagarajan, B. et al. Creation of engineered human embryonic stem cell lines using phiC31 integrase. Stem Cells 26, 119-126 (2008).
53. Olivares, E. C. et al. Site-specific genomic integration produces therapeutic Factor IX levels in mice. Nat Biotechnol 20, 1124-1128 (2002).
54. Hollis, R. P. et al. Phage integrases for the construction and manipulation of transgenic mammals. Reprod Biol Endocrinol 1, 79 (2003).
55. Held, P. K. et al. In vivo correction of murine hereditary tyrosinemia type I by phiC31 integrase-mediated gene delivery. Mol Ther 11, 399-408 (2005).
56. Ma, H. et al. PhiC31 integrase induces efficient site-specific recombination in the Capra hircus genome. DNA Cell Biol 33, 484-491 (2014).
57. Bi, Y. et al. Pseudo attP sites in favor of transgene integration and expression in cultured porcine cells identified by Streptomyces phage phiC31 integrase. BMC Mol Biol 14, 20 (2013).
58. Ma, Q. W. et al. Identification of pseudo attP sites for phage phiC31 integrase in bovine genome. Biochem Biophys Res Commun 345, 984-988 (2006).
59. Qu, L. et al. Global mapping of binding sites for phic31 integrase in transgenic maden-darby bovine kidney cells using ChIP-seq. Hereditas 156, 3 (2019).
60. Ghahfarokhi, M. K., Dormiani, K., Mohammadi, A., Jafarpour, F. & Nasr-Esfahani, M. H. Blastocyst Formation Rate and Transgene Expression are Associated with Gene Insertion into Safe and Non-Safe Harbors in the Cattle Genome. Sci Rep 7, 15432 (2017).
61. Groth, A. C., Fish, M., Nusse, R. & Calos, M. P. Construction of transgenic Drosophila by using the site-specific integrase from phage phiC31. Genetics 166, 1775-1782 (2004).
62. Chalberg, T. W., Genise, H. L., Vollrath, D. & Calos, M. P. phiC31 integrase confers genomic integration and long-term transgene expression in rat retina. Invest Ophthalmol Vis Sci 46, 2140-2146 (2005).
63. Keravala, A. et al. A diversity of serine phage integrases mediate site-specific recombination in mammalian cells. Mol Genet Genomics 276, 135-146 (2006).
64. Lei, X., Wang, L., Zhao, G. & Ding, X. Site-specificity of serine integrase demonstrated by the attB sequence preference of BT1 integrase. FEBS Lett 592, 1389-1399 (2018).
65. Chu, V. T. et al. Increasing the efficiency of homology-directed repair for CRISPR-Cas9-induced precise gene editing in mammalian cells. Nat Biotechnol 33, 543-548 (2015).
66. Yu, C. et al. Small molecules enhance CRISPR genome editing in pluripotent stem cells. Cell Stem Cell 16, 142-147 (2015).
67. Paquet, D. et al. Efficient introduction of specific homozygous and heterozygous mutations using CRISPR/Cas9. Nature 533, 125 (2016).
68. Martsolf, J. T. et al. Complete trisomy 17p a relatively new syndrome. Ann Genet 31, 172-174 (1988).
69. Bird, T. D. in GeneReviews®. (eds. M. P. Adam et al.) (Seattle (Wash.); 1993).
70. Smith, A. C. M. et al. in GeneReviews®. (eds. M. P. Adam et al.) (Seattle (Wash.); 1993).
71. Dupuy, O. et al. [De La Chapelle syndrome]. Presse Med 30, 369-372 (2001).
72. Jyothy, A. et al. Translocation Down syndrome. Indian J Med Sci 56, 122-126 (2002).
73. Lakich, D., Kazazian, H. H., Jr., Antonarakis, S. E. & Gitschier, J. Inversions disrupting the factor VIII gene are a common cause of severe haemophilia A. Nat Genet 5, 236-241 (1993).
74. Bondeson, M. L. et al. Inversion of the IDS gene resulting from recombination with IDS-related sequences is a common cause of the Hunter syndrome. Hum Mol Genet 4, 615-621 (1995).
75. Abremski, K. & Hoess, R. Bacteriophage P1 site-specific recombination. Purification and properties of the Cre recombinase protein. J Biol Chem 259, 1509-1514 (1984).
76. Sauer, B. & McDermott, J. DNA recombination with a heterospecific Cre homolog identified from comparison of the pac-c1 regions of P1-related phages. Nucleic Acids Res 32, 6086-6095 (2004).
77. Suzuki, E. & Nakayama, M. VCre/VloxP and SCre/SloxP: new site-specific recombination systems for genome engineering. Nucleic Acids Res 39, e49 (2011).
78. Sadowski, P. D. The Flp recombinase of the 2-microns plasmid of Saccharomyces cerevisiae. Prog Nucleic Acid Res Mol Biol 51, 53-91 (1995).
79. Nern, A., Pfeiffer, B. D., Svoboda, K. & Rubin, G. M. Multiple new site-specific recombinases for use in manipulating animal genomes. Proc Natl Acad Sci USA 108, 14198-14203 (2011).
80. Ringrose, L., Angrand, P. O. & Stewart, A. F. The Kw recombinase, an integrase from *Kluyveromyces waltii*. Eur J Biochem 248, 903-912 (1997).
81. Araki, H. et al. Site-specific recombinase, R, encoded by yeast plasmid pSR1. J Mol Biol 225, 25-37 (1992).
82. Blaisonneau, J., Sor, F., Cheret, G., Yarrow, D. & Fukuhara, H. A circular plasmid from the yeast *Torulaspora delbrueckii*. Plasmid 38, 202-209 (1997).
83. Karimova, M. et al. Vika/vox, a novel efficient and specific Cre/loxP-like site-specific recombination system. Nucleic Acids Res 41, e37 (2013).
84. Karimova, M., Splith, V., Karpinski, J., Pisabarro, M. T. & Buchholz, F. Discovery of Nigri/nox and Panto/pox site-specific recombinase systems facilitates advanced genome engineering. Sci Rep 6, 30130 (2016).
85. Buchholz, F. & Stewart, A. F. Alteration of Cre recombinase site specificity by substrate-linked protein evolution. Nat Biotechnol 19, 1047-1052 (2001).
86. Santoro, S. W. & Schultz, P. G. Directed evolution of the site specificity of Cre recombinase. Proc Natl Acad Sci USA 99, 4185-4190 (2002).
87. Sarkar, I., Hauber, I., Hauber, J. & Buchholz, F. HIV-1 proviral DNA excision using an evolved recombinase. Science 316, 1912-1915 (2007).
88. Rufer, A. W. & Sauer, B. Non-contact positions impose site selectivity on Cre recombinase. Nucleic Acids Res 30, 2764-2771 (2002).
89. Kim, A. I. et al. Mycobacteriophage Bxb1 integrates into the Mycobacterium smegmatis groEL1 gene. Mol Microbiol 50, 463-473 (2003).

90. Brown, D. P., Idler, K. B. & Katz, L. Characterization of the genetic elements required for site-specific integration of plasmid pSE211 in *Saccharopolyspora erythraea*. J Bacteriol 172, 1877-1888 (1990).
91. Matsuura, M. et al. A GENE ESSENTIAL FOR THE SITE-SPECIFIC EXCISION OF ACTINOPHAGE R4 PROPHAGE GENOME FROM THE CHROMOSOME OF A LYSOGEN. The Journal of General and Applied Microbiology 41, 53-61 (1995).
92. Gregory, M. A., Till, R. & Smith, M. C. Integration site for Streptomyces phage phiBT1 and development of site-specific integrating vectors. J Bacteriol 185, 5320-5323 (2003).
93. Yang, H. Y., Kim, Y. W. & Chang, H. I. Construction of an integration-proficient vector based on the site-specific recombination mechanism of enterococcal temperate phage phiFC1. J Bacteriol 184, 1859-1864 (2002).
94. Rashel, M. et al. A novel site-specific recombination system derived from bacteriophage phiMR11. Biochem Biophys Res Commun 368, 192-198 (2008).
95. Christiansen, B., Johnsen, M. G., Stenby, E., Vogensen, F. K. & Hammer, K. Characterization of the lactococcal temperate phage TP901-1 and its site-specific integration. J Bacteriol 176, 1069-1076 (1994).
96. Loessner, M. J., Inman, R. B., Lauer, P. & Calendar, R. Complete nucleotide sequence, molecular analysis and genome structure of bacteriophage A118 of Listeria monocytogenes: implications for phage evolution. Mol Microbiol 35, 324-340 (2000).
97. Lauer, P., Chow, M. Y., Loessner, M. J., Portnoy, D. A. & Calendar, R. Construction, characterization, and use of two Listeria monocytogenes site-specific phage integration vectors. J Bacteriol 184, 4177-4186 (2002).
98. Bibb, L. A., Hancox, M. I. & Hatfull, G. F. Integration and excision by the large serine recombinase phiRv1 integrase. Mol Microbiol 55, 1896-1910 (2005).
99. Canchaya, C. et al. Genome analysis of an inducible prophage and prophage remnants integrated in the *Streptococcus pyogenes* strain SF370. Virology 302, 245-258 (2002).
100. Morita, K. et al. The site-specific recombination system of actinophage TG1. FEMS Microbiol Lett 297, 234-240 (2009).
101. Fouts, D. E. et al. Sequencing *Bacillus anthracis* typing phages gamma and cherry reveals a common ancestry. J Bacteriol 188, 3402-3408 (2006).
102. Kilcher, S., Loessner, M. J. & Klumpp, J. *Brochothrix thermosphacta* bacteriophages feature heterogeneous and highly mosaic genomes and utilize unique prophage insertion sites. J Bacteriol 192, 5441-5453 (2010).
103. Lazarevic, V. et al. Nucleotide sequence of the *Bacillus subtilis* temperate bacteriophage SPbetac2. Microbiology 145 (Pt 5), 1055-1067 (1999).
104. Fogg, P. C. M., Haley, J. A., Stark, W. M. & Smith, M. C. M. Genome Integration and Excision by a New *Streptomyces* Bacteriophage, varphiJoe. Appl Environ Microbiol 83 (2017).
105. Yang, L. et al. Permanent genetic memory with >1-byte capacity. Nat Methods 11, 1261-1266 (2014).
106. Rutherford, K., Yuan, P., Perry, K., Sharp, R. & Van Duyne, G. D. Attachment site recognition and regulation of directionality by the serine integrases. Nucleic Acids Res 41, 8341-8356 (2013).
107. Singh, S., Rockenbach, K., Dedrick, R. M., VanDemark, A. P. & Hatfull, G. F. Cross-talk between diverse serine integrases. J Mol Biol 426, 318-331 (2014).
108. Gupta, N. et al. Cross-talk between cognate and non-cognate RpoE sigma factors and Zn(2+)-binding anti-sigma factors regulates photooxidative stress response in *Azospirillum brasilense*. Antioxid Redox Signal 20, 42-59 (2014).
109. Kahmann, R., Rudt, F., Koch, C. & Mertens, G. G inversion in bacteriophage Mu DNA is stimulated by a site within the invertase gene and a host factor. Cell 41, 771-780 (1985).
110. Iida, S., Meyer, J., Kennedy, K. E. & Arber, W. A site-specific, conservative recombination system carried by bacteriophage P1. Mapping the recombinase gene cin and the cross-over sites cix for the inversion of the C segment. EMBO J 1, 1445-1453 (1982).
111. Glasgow, A. C., Bruist, M. F. & Simon, M. I. DNA-binding properties of the Hin recombinase. J Biol Chem 264, 10072-10082 (1989).
112. Iida, S. et al. The Min DNA inversion enzyme of plasmid p15B of *Escherichia coli* 15T-: a new member of the Din family of site-specific recombinases. Mol Microbiol 4, 991-997 (1990).
113. Rowland, S. J., Stark, W. M. & Boocock, M. R. Sin recombinase from *Staphylococcus aureus*: synaptic complex architecture and transposon targeting. Mol Microbiol 44, 607-619 (2002).
114. Kolot, M., Silberstein, N. & Yagil, E. Site-specific recombination in mammalian cells expressing the Int recombinase of bacteriophage HK022. Mol Biol Rep 26, 207-213 (1999).
115. Cho, E. H., Nam, C. E., Alcaraz, R., Jr. & Gardner, J. F. Site-specific recombination of bacteriophage P22 does not require integration host factor. J Bacteriol 181, 4245-4249 (1999).
116. Lee, M. H., Pascopella, L., Jacobs, W. R., Jr. & Hatfull, G. F. Site-specific integration of mycobacteriophage L5: integration-proficient vectors for Mycobacterium smegmatis, Mycobacterium tuberculosis, and bacille Calmette-Guerin. Proc Natl Acad Sci USA 88, 3111-3115 (1991).

Example 18—Incorporation of 3' Toeloop in the Primer Binding Site (PBS) Improves PEgRNA Activity In order to further improve PE activity, the inventors contemplated adding a toeloop sequence at the 3' end of a PEgRNA having a 3' extension arm. FIG. 71A provides an example of a generic SpCas9 PEgRNA having a 3' extension arm (top molecule). The 3' extension arm, in turn, comprises an RT template (that includes that the desired edit) and a primer binding site (PBS) at the 3' end of the molecule. The molecule terminates with a poly(U) sequence comprising three U nucleobases (i.e., 5'-UUU-3').

By contrast, the bottom portion of FIG. 71A shows the same PEgRNA molecule as the top portion of FIG. 71A, but wherein a 9-nucleobase sequence of 5'-GAAANNNN-3' has been inserted between the 3' end of the primer binding site and the 5' end of the terminal poly(U) sequence. This structure folds back on itself by 180° to form a "toeloop" RNA structure, wherein the sequences of 5'-NNNNN-3' of the 9-nucleobase insertion anneals with a complementary sequence in the primer binding site, and wherein the 5'-GAAA-3' portion forms the 180° turn. The features of the toeloop sequence depicted in FIG. 71A is not intended to limit or narrow the scope of possible toeloops that could be used in its place. Further, the sequence of the toeloop will depend upon the complementary sequence of the primer binding site. Essentially though, the toeloop sequence, in various embodiments, may have a first sequence portion that forms a 180°, and a second sequence portion that has a sequence that is complentary to a portion of the primer binding site.

Without being bound by theory, the toeloop sequence is thought to enable PEgRNA the use of PEgRNAs with increasingly longer primer binding sites than would otherwise be possible. Longer PBS sequences, in turn, are thought to improve PE activity. PEgRNA More in particular, the likely function of the toeloop is to occlude or at least minimize the PBS from interacting with the spacer. Stable hairpin formation between the PBS and the spacer can lead to an inactive PEgRNA. Without a toeloop, this interaction may require restricting the length of the PBS. Blocking or minimizing the interaction between the spacer and the PBS using a 3' end toeloop may lead to an improvement in PE activity.

Example 19—Prime Editing with Alternative Nucleic Acid Templates and Editor Protein Constructs Prior to this example, prime editing is described as requiring a PEgRNA. Exemplary embodiments describing possible configurations of suitable PEgRNA for use in prime editing are depicted in FIG. 3A (a PEgRNA with a 5' extension arm), FIG. 3B (a PEgRNA with a 3' extension arm), FIG. 3C (an internally extended PEgRNA), FIG. 3D (a PEgRNA with a 3' extension arm, and comprising a primer binding site, edit template, homology arm, and optional 3' and 5' modifier regions, and a region indicated as the DNA synthesis template), and FIG. 3E (a PEgRNA with a 5' extension arm, and comprising a primer binding site, edit template, homology arm, and optional 3' and 5' modifier regions, and a region indicated as the DNA synthesis template). In addition, PEgRNA structure and composition are described extensively herein in the Detailed Description and throughout.

This Example describes additional design variations of PEgRNAs—in some cases, PEgRNAs which are wholly or partially chemically synthesized outside the cell—that are envisioned to work in conjunction with the prime editors of this Specification. Such alternative designs may improve various aspects of prime editing, including the insertion of longer DNA sequences by prime editing, the use of alternative polymerases (i.e., alternatives to reverse transcriptase) that potentially operate with increased efficiency and/or fidelity, and the use or recruitment of alternative and/or addition prime editor protein effector components to enhance or augment prime editing. In addition, the use of chemically synthesized PEgRNAs may potentially lead to the production of molecules that are more stable and possess desirable features that enhance prime editing efficiency and capabilities.

PEgRNA serves as the nucleic acid template that encodes the desired edited genetic information that is to be incorporated into a target site. In one aspect, a PEgRNA is created by adding an extension arm to either the 5' end or 3' end of an sgRNA (e.g., as shown in the embodiments of FIG. 3A, 3B, 3D, or 3E), or by inserting a similar sequence internally within an sgRNA (e.g., as shown in the embodiment of FIG. 3C), wherein the extension arm comprises a DNA synthesis template that is capable of encoding a ssDNA product by a polymerase (e.g., a reverse transcriptase) and which includes the edited genetic information of interest. The extension arm comprises a primer binding site (PBS) for annealing to the napDNAbp-nicked genomic DNA strand, and a DNA synthesis template to encode t the edited DNA strand of interest, which becomes incorporated into the endogenous DNA target site by replacing the counterpart DNA strand. PEgRNA can be expressed within cells from plasmid DNA or a genomically integrated DNA cassette, or they can be made outside of cells by in vitro transcription or by chemical synthesis and subsequently delivered into cells. Preparation of PEgRNAs outside of cells, particularly by chemical synthesis, offers an opportunity to modify the PEgRNAs substantially. This invention describes alternative designs for prime editing templates (FIG. 72).

(A) DNA Synthesis Template Expressed as a Separate Molecules from Guide RNAs (i.e., DNA Synthesis Template Provided in Trans to the Prime Editor Complex (napDNAbp+Guide RNA).

In various embodiments described herein, prime editing utilizes a single PEgRNA that serves as both the programmable targeting molecules and the edit-encoding molecule. This embodiment is depicted in FIG. 72(*a*) with a PEgRNA having a 3' extension arm. However, in some cases, this could be disadvantageous, particularly for more complex PEgRNA molecules such as those that encode a large insertion. These RNAs could contain extensive secondary structure that interferes with the PEgRNA scaffold structure and interactions with Cas9. Alternatively, prime editing can be carried out by substituting a PEgRNA with two separate RNA molecules: an sgRNA, and a trans prime editing RNA template (tPERT), as depicted in FIG. 72B. The sgRNA serves to target Cas9 (or more generally, the napDNAbp) to the desired genomic target site, while the tPERT is used by the polymerase (e.g., a reverse transcriptase) to write new DNA sequence into the target locus.

In general, simple expression of a tPERT leads to lower editing efficiency compared to a PEgRNA. However, the efficiency of trans prime editing can be enhanced by the introduction of one or more MS2 RNA aptamers into the tPERT RNA, along with a fusion of the MS2 coat protein (MS2cp) to the prime editor protein (to make MS2cp-Cas9-RT). This allows for the MS2 RNA aptamer to bind to the MS2cp, thereby co-localizing the tPERT (which comprises the DNA synthesis template) to the site of editing by the prime editor complex. The MS2 aptamer is preferably placed on the 3' end of the tPERT to avoid reverse transcription of the aptamer sequence.

Although this example utilizes the MS2 tagging technique (comprising the MS2 RNA aptamer on the tPERT paired with the MS2cp protein fused to the prime editor), other RNA-protein recruitment systems can be used in the alternative. The general concept envisioned here is that the DNA synthesis template of the tPERT is modified to contain an RNA recruitment secondary structure (e.g., a specialized hairpin like the MS2 aptamer) so that the tPERT may be recruited by a modified prime editor fusion protein that further comprises an RNA-binding protein that specifically recognizes and binds to the RNA recruitment second structure on the tPERT molecule. A review of other RNA-protein recruitment domains are described in the art, for example, in Johansson et al., "RNA recognition by the MS2 phage coat protein," *Sem Virol.,* 1997, Vol. 8(3): 176-185; Delebecque et al., "Organization of intracellular reactions with rationally designed RNA assemblies," *Science,* 2011, Vol. 333: 470-474; Mali et al., "Cas9 transcriptional activators for target specificity screening and paired nickases for cooperative genome engineering," *Nat. Biotechnol.,* 2013, Vol. 31: 833-838; and Zalatan et al., "Engineering complex synthetic transcriptional programs with CRISPR RNA scaffolds," *Cell,* 2015, Vol. 160: 339-350, each of which are incorporated herein by reference in their entireties. Other systems include the PP7 hairpin, which specifically recruits the PCP protein, and the "corn" hairpin, which specifically recruits the Corn protein. See Zalatan et al. Any of these well-known recruitment systems may be employed with trans prime editing as described herein.

The efficiency of the instant tPERT trans prime editing system was tested. Up to 20% efficiency of His6 insertion (18 bp) was achieved at the HEK3 site in HEK293T cells using a tPERT containing a single 3' MS2 aptamer, a 13-nt primer binding site, and an RT template containing the insertion sequence and 34 nt of homology to the locus, along with an editor containing the MS2cp fused to the N-terminus of PE2. See FIG. 73. The strategy of trans prime editing has the potential to address complications associated with PEgRNAPEgRNA design, and could be more suited for longer RT templates to achieve larger insertion, deletions, or edits at further distances from the prime editor nick site.

(B) Chemically Synthesized PEgRNAs with RNA and DNA Synthesis Templates

Alternative nucleic acid templates can be used within chemically synthesized PEgRNAs (FIG. 72C). For example, a synthetic PEgRNA can be constructed as an RNA/DNA hybrid wherein the spacer sequence and sgRNA scaffold is composed of RNA nucleotides and the primer binding site and synthesis template (shown as a 3' extension in FIG. 72C) is composed of DNA nucleotides. This could allow for DNA-dependent DNA polymerases to be used in place of reverse transcriptase within prime editors. It could also prevent the synthesis of DNA that is templated by sgRNA scaffold sequence. In other designs, chemical linkers, composed of non-templating nucleotides or other suitable linker moieties, can be used to tether the nucleic acid edit template (composed of RNA or DNA) to the sgRNA scaffold. This could prevent continued DNA polymerization of the sgRNA scaffold and allow for flexibility in the extension that allows for more efficient templated synthesis. Finally, the directionality of the nucleic acid synthesis template can be inverted such that DNA polymerization proceeds away from the sgRNA scaffold as opposed to toward it.

(C) Recruitment of the DNA Polymerase Expressed in Trans

In the main embodiment of prime editing, the polymerase (e.g., reverse transcriptase enzyme) is expressed as a fusion to the napDNAbp (e.g., Cas9 nickase). Alternatively, the polymerase (e.g., reverse transcriptase) can be expressed in trans, and its activity can be localized to the editing site using recruitment systems such as the MS2 RNA aptamer and MS2 coat protein, or other similar recruitment system known in the art. In this system, the PEgRNA is modified to include an MS2 aptamer within one of the sgRNA scaffold hairpins, and the polymerase (e.g., reverse transcriptase) is expressed as a fusion protein to MS2cp. The napDNAbp (e.g., Cas9 nickase) is also expressed as an independent polypeptide. This system has been demonstrated with the wild type M-MLV reverse transcriptase (FIG. 74), and should be applicable to other RT variants. In addition, other RNA-protein interactions, or protein-protein interactions, could be used for RT recruitment.

The following sequences are pertinent to Example 19:
Sequences of tPERTs:
MS2 Aptamer/RT Template/PBS/Linker
5'-MS2_13nt-PBS:

(SEQ ID NO: 762)
5'<u>GCCAACATGAGGATCACCCATGTCTGCAGGGCC</u>TGGAGGAAGCAGG

GCTTCCTTTCCTCTGCCATCAATGATGGTGATGATGGTGCGTGCTCAGT

CTG-3'

5'-MS2_17nt-PBS:

(SEQ ID NO: 773)
5'<u>GCCAACATGAGGATCACCCATGTCTGCAGGGCC</u>TGGAGGAAGCAGGGC

TTCCTTTCCTCTGCCATCAATGATGGTGATGATGGTGCGTGCTCAGTCTG

GGCC-3'

3'-MS2_13nt-PBS:

(SEQ ID NO: 774)
5'GGAGGAAGCAGGGCTTCCTTTCCTCTGCCATCAATGATGGTGATGAT

GGTGCGTGCTCAGTCTGAAATTAACAAATCAA<u>GCCAACATGAGGATCAC</u>

<u>CCAGCAGGGCC</u>-3'

3'-MS2_17nt-PBS:

(SEQ ID NO: 775)
5'TGTCTGGAGGAAGCAGGGCTTCCTTTCCTCTGCCATCAATGATGGTGA

TGATGGTGCGTGCTCAGTCTGGGCCAAATTAACAAATCAA<u>GCCAACATGA</u>

<u>GGATCACCCATGTCTGCAGGGCC</u>-3'

Sequences of MS2 PEgRNAs:
Spacer/MS2 Aptamer/sgRNA Scaffold/RT Template/PBS
HEK3_MS2_1

(SEQ ID NO: 776)
5'GGCCCAGACTGAGCACGTGAGTTTTAGAGCTAG<u>GCCAACATGAGGATC</u>

<u>ACCCATGTCTGCAGGGCC</u>TAGCAAGTTAAAATAAGGCTAGTCCGTTATCA

ACTTGAAAAAGTGGGACCGAGTCGGTCCTCTGCCATCTCGTGCTCAGT

CT-3'

HEK3_MS2_2

(SEQ ID NO: 777)
5'GGCCCAGACTGAGCACGTGAGTTTTAGAGCTAGAAATAGCAAGTTAAA

ATAAGGCTAGTCCGTTATCAACTTG<u>GCCAACATGAGGATCACCCATGTCT</u>

<u>GCAGGGCC</u>AAGTGGGACCGAGTCGGTCCTCTGCCATCTCGTGCTCAG

TCT-3'

Protein Sequences:

MS2cp-PE2
(SEQ ID NO: 778)
cMKRTADGSEFESPKKKRKV<u>GSASNFTQFVLVDNGGTGDVTVAPSNFANGVAEWISS</u>

<u>NSRSQAYKVTCSVRQSSAQNRKYTIKVEVPKVATQTVGGEELPVAGWRSYLNMELT</u>

<u>IPIFATNSDCELIVKAMQGLLKDGNPIPSAIAANSGIY</u>SGGSSGGSSGSETPGTSESATP

ESSGGSSGGSSDKKYSIGLDIGTNSVGWAVITDEYKVPSKKFKVLGNTDRHSIKKNLIGALL
FDSGETAEATRLKRTARRRYTRRKNRICYLQEIFSNEMAKVDDSFFHRLEESFLVEEDKKH
ERHPIFGNIVDEVAYHEKYPTIYHLRKKLVDSTDKADLRLIYLALAHMIKFRGHFLIEGDLN
PDNSDVDKLFIQLVQTYNQLFEENPINASGVDAKAILSARLSKSRRLENLIAQLPGEKKNGL
FGNLIALSLGLTPNFKSNFDLAEDAKLQLSKDTYDDDLDNLLAQIGDQYADLFLAAKNLS
DAILLSDILRVNTEITKAPLSASMIKRYDEHHQDLTLLKALVRQQLPEKYKEIFFDQSKNGY
AGYIDGGASQEEFYKFIKPILEKMDGTEELLVKLNREDLLRKQRTFDNGSIPHQIHLGELH
AILRRQEDFYPFLKDNREKIEKILTFRIPYYVGPLARGNSRFAWMTRKSEETITPWNFEEVV
DKGASAQSFIERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRRRYTGWGRLSR
KLINGIRDKQSGKTILDFLKSDGFANRNFMQLIHDDSLTFKEDIQKAQVSGQGDSLHEHIA
NLAGSPAIKKGILQTVKVVDELVKVMGRHKPENIVIEMARENQTTQKGQKNSRERMKRIE
EGIKELGSQILKEHPVENTQLQNEKLYLYYLQNGRDMYVDQELDINRLSDYDVDAIVPQSF
LKDDSIDNKVLTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVITLKSKLVSDFRK
DFQFYKVREINNYHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGRDFATVRKVLSMP
QVNIVKKTEVQTGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKYSLFELENGRKRM
LASAGELQKGNELALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAAFKYFDTTIDRKRY
TSTKEVLDATLIHQSITGLYETRIDLSQLGGDSGGSSGGSSGSETPGTSESATPESSGGSSGG
SSTLNIEDEYRLHETSKEPDVSLGSTWLSDFPQAWAETGGMGLAVRQAPLIIPLKATSTPVS
IKQYPMSQEARLGIKPHIQRLLDQGILVPCQSPWNTPLLPVKKPGTNDYRPVQDLREVNK
RVEDIHPTVPNPYNLLSGLPPSHQWYTVLDLKDAFFCLRLHPTSQPLFAFEWRDPEMGIS
GQLTWTRLPQGFKNSPTLFNEALHRDLADFRIQHPDLILLQYVDDLLLAATSELDCQQGT
RALLQTLGNLGYRASAKKAQICQKQVKYLGYLLKEGQRWLTEARKETVMGQPTPKTPRQ
LREFLGKAGFCRLFIPGFAEMAAPLYPLTKPGTLFNWGPDQQKAYQEIKQALLTAPALGL
PDLTKPFELFVDEKQGYAKGVLTQKLGPWRRPVAYLSKKLDPVAAGWPPCLRMVAAIAV
LTKDAGKLTMGQPLVILAPHAVEALVKQPPDRWLSNARMTHYQALLLDTDRVQFGPVVA
LNPATLLPLPEEGLQHNCLDILAEAHGTRPDLTDQPLPDADHTWYTDGSSLLQEGQRKA
GAAVTTETEVIWAKALPAGTSAQRAELIALTQALKMAEGKKLNVYTDSRYAFATAHIHGEIY
RRRGWLTSEGKEIKNKDEILALLKALFLPKRLSIIHCPGHQKGHSAEARGNRMADQAARK
AAITETPDTSTLLIENSSPSGGSKRTADGSEFEPKKKRKV

MS2cp-MMLV-RT (SEQ ID NO: 779)

MKRTADGSEFESPKKKRKVGSASNFTQFVLVDNGGTGDVTVAPSNFANGV
AEWISSNSRSQAYKVTCSVRQSSAQNRKYTIKVEVPKVATQTVGGEELPV
AGWRSYLNMELTIPIFATNSDCELIVKAMQGLLKDGNPIPSAIAANSGIY
SGGSSGGSSGGSGSETPGTSESATPESSGGSSGGSSTLNIEDEYRLHETSKEP
DVSLGSTWLSDFPQAWAETGGMGLAVRQAPLIIPLKATSTPVSIKQYPMS
QEARLGIKPHIQRLLDQGILVPCQSPWNTPLLPVKKPGTNDYRPVQDLRE

```
-continued
VNKRVEDIHPTVPNPYNLLSGLPPSHQWYTVLDLKDAFFCLRLHPTSQPL

FAFEWRDPEMGISGQLTWTRLPQGFKNSPTLFDEALHRDLADFRIQHPDL

ILLQYVDDLLLAATSELDCQQGTRALLQTLGNLGYRASAKKAQICQKQVK

YLGYLLKEGQRWLTEARKETVMGQPTPKTPRQLREFLGTAGFCRLWIPGF

AEMAAPLYPLTKTGTLFNWGPDQQKAYQEIKQALLTAPALGLPDLTKPFE

LFVDEKQGYAKGVLTQKLGPWRRPVAYLSKKLDPVAAGWPPCLRMVAAIA

VLTKDAGKLTMGQPLVILAPHAVEALVKQPPDRWLSNARMTHYQALLLDT

DRVQFGPVVALNPATLLPLPEEGLQHNCLDILAEAHGTRPDLTDQPLPDA

DHTWYTDGSSLLQEGQRKAGAAVTTETEVIWAKALPAGTSAQRAELIALT

QALKMAEGKKLNVYTDSRYAFATAHIHGEIYRRRGLLTSEGKEIKNKDEI

LALLKALFLPKRLSIIHCPGHQKGHSAEARGNRMADQAARKAAITETPDT

STLLIENSSPSGGSKRTADGSEFEPKKKRKV

MMLV-RT-MS2cp
                                      (SEQ ID NO: 780)
MKRTADGSEFESPKKKRKVTLNIEDEYRLHETSKEPDVSLGSTWLSDFPQ

AWAETGGMGLAVRQAPLIIPLKATSTPVSIKQYPMSQEARLGIKPHIQRL

LDQGILVPCQSPWNTPLLPVKKPGTNDYRPVQDLREVNKRVEDIHPTVPN

PYNLLSGLPPSHQWYTVLDLKDAFFCLRLHPTSQPLFAFEWRDPEMGISG

QLTWTRLPQGFKNSPTLFDEALHRDLADFRIQHPDLILLQYVDDLLLAAT

SELDCQQGTRALLQTLGNLGYRASAKKAQICQKQVKYLGYLLKEGQRWLT

EARKETVMGQPTPKTPRQLREFLGTAGFCRLWIPGFAEMAAPLYPLTKTG

TLFNWGPDQQKAYQEIKQALLTAPALGLPDLTKPFELFVDEKQGYAKGVL

TQKLGPWRRPVAYLSKKLDPVAAGWPPCLRMVAAIAVLTKDAGKLTMGQP

LVILAPHAVEALVKQPPDRWLSNARMTHYQALLLDTDRVQFGPVVALNPA

TLLPLPEEGLQHNCLDILAEAHGTRPDLTDQPLPDADHTWYTDGSSLLQE

GQRKAGAAVTTETEVIWAKALPAGTSAQRAELIALTQALKMAEGKKLNVY

TDSRYAFATAHIHGEIYRRRGLLTSEGKEIKNKDEILALLKALFLPKRLS

IIHCPGHQKGHSAEARGNRMADQAARKAAITETPDTSTLLIENSSPSGGS

SGGSSGSETPGTSESATPESSGGSSGGSSGSASNFTQFVLVDNGGTGDVT

VAPSNFANGVAEWISSNSRSQAYKVTCSVRQSSAQNRKYTIKVEVPKVAT

QTVGGEELPVAGWRSYLNMELTIPIFATNSDCELIVKAMQGLLKDGNPIP

SAIAANSGIYSGGSKRTADGSEFEPKKKRKV
```

Example 20. Split-Intein Delivery of Prime Editors

This Example demonstrates that a prime editor may be split using inteins as a means to deliver the prime editor to cells via separate vectors, wherein each vector encodes a portion of the prime editor fusion protein. This Example is focused on a PE fusion protein comprising the canonical SpCas9 (SEQ ID NO: 18). The split sites for other Cas9 proteins may be the corresponding same site, or may need to be optimized for each different Cas9 protein. In the instant Example, the prime editor was split between residues 1023 and 1024 of SpCas9 (SEQ ID NO: 18). This is referred to as the "1023/1024" split site.

Prime editors (PEs) exceed the AAV packaging capacity. It was therefore contemplated to split the PE by inserting a trans-splicing Npu intein at S. pyogenes Cas9 residue 1024 in SEQ ID NO: 18, allowing delivery of split-SpPEs as two separate polypeptides, each encoded by one of a dual-AAV system. The split site 1023/1024 was chosen because it (1) allows packaging into two AAVs while accommodating space for guide cassette(s) and minimal regulatory elements, (2) mutation of the native Serine to Cysteine would be relatively conservative, (3) the site is a flexible loop near the periphery of Cas9 which sterically is predicted to allow for splicing to occur, and (4) Cas9 has been successfully altered in this loop by circular permutation (but not previously at this specific split site).

To determine whether Npu-split prime editors are active, HEK cells were transfected with plasmids encoding split-editors, finding they recapitulate activity of full-length PE3 as analyzed by high-throughput sequencing. Furthermore, the three native Npu amino-terminal residues of C-terminal extein are known to splice most efficiently but differ from those natively flanking Cas9 residue 1024. Replacement of these Cas9 residues with the native Npu residues may alter the activity of prime editor. It was therefore determined whether mutation from the Cas9-native "SEQ" towards the Npu intein "CFN" sequence altered efficiency of prime editing. The "SEQ" residues facilitate prime editing with similar efficiency to full-length, suggesting the intein-split PE halves are able to associate and mediate prime editing. No further increase was seen by mutation towards "CFN", suggesting that association alone may be sufficient for split-PE activity, as we have previously observed with intein-split base editors.

Although associated, unspliced editors may be active, perturbations of the sterics of the prime editor resulting from incomplete splicing during initiation steps may affect editing outcomes. 1024-CFN was therefore chosen for further studies as it also recapitulates full-length PE3 activity.

The following are the amino acid sequences of the 1023/1024 split.

SpPE2 Split at 1023/1024 N Terminal Half

```
                                     (SEQ ID NO: 3875)
MKRTADGSEFESPKKKRKVDKKYSIGLDIGTNSVGWAVITDEYKVPSKKF

KVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKY

PTIYHLRKKLVDSTDKADLRLIYLALAHMIKFRGHFLIEGDLNPDNSDVD

KLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQI

GDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTE

GMRKPAFLSGEQKKAIVDLLFKTNRKVTVKQLKEDYFKKIECFDSVEISG

VEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPA
```

-continued

IKKGILQTVKVVDELVKVMGRHKPENIVIEMARENQTTQKGQKNSRERMK

RIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHVA

QILDSRMNTKYDENDKLIREVKVITLKSKLVSDFRKDFQFYKVREINNYH

HAHDAYLNAVVGTALIKKYPKLESEFVYGDYKVYDVRKMIAK

*CLSYETEILTVEYGLLPIGKIVEKRIECTVYSVDNNGNIYTQPVAQW*

*HDRGEQEVEEYCLEDGSLIRATKDHKFMTVDGQMLPIDEIFERELDL*

*MRVDNLPNS*GGS*KRTADGSEFEPKKKRKV*

SpPE2 Split at 1023/1024 C Terminal Half (SEQ ID NO: 3876)
MKRTADGSEFESPKKKRKV

*IKIATRKYLGKQNVYDIGVERDHNFALKNGFIASN*CFNEIGKATAKYFFYS

NIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEV

KKDLIIKLPKYSLFELENGRKRMLASAGELQKGNELALPSKYVNFLYLAS

HYEKLKGSPEDNEQKQLFVEQHKHYLDEIIEQISEFSKRVILADANLDKV

TLSAYNKHRDKPIREQAENIIHLFLTNLGAPAAFKYFDTTIDRKRYTSTK

EVLDATLIHQSITGLYETRIDLSQLGGI*SGGS*

*GGSSGSETPGTSESATPESSGGSSGGSS*TLNIEDEYRLHETS

KEPDVSLGSTWLSDFPQAWAETGGMGLAVRQAPLIIPLKATSTPVSIKQY

PMSQEARLGIKPHIQRLLDQGILVPCQSPWNTPLLPVKKPGTNDYRPVQD

LREVNKRVEDIHPTVPNPYNLLSGLPPSHQWYTVLDLKDAFFCLRLHPTS

QPLFAFEWRDPEMGISGQLTWTRLPQGFKNSPTLFNEALHRDLADFRIQH

PDLILLQYVDDLLLAATSELDCQQGTRALLQTLGNLGYRASAKKAQICQK

QVKYLGYLLKEGQRWLTEARKETVMGQPTPKTPRQLREFLGKAGFCRLFI

PGFAEMAAPLYPLTKPGTLFNWGPDQQKAYQEIKQALLTAPALGLPDLTK

PFELFVDEKQGYAKGVLTQKLGPWRRPVAYLSKKLDPVAAGWPPCLRMVA

AIAVLTKDAGKLTMGQPLVILAPHAVEALVKQPPDRWLSNARMTHYQALL

LDTDRVQFGPVVALNPATLLPLPEEGLQHNCLDILAEAHGTRPDLTDQPL

PDADHTWYTDGSSLLQEGQRKAGAAVTTETEVIWAKALPAGTSAQRAELI

ALTQALKMAEGKKLNVYTDSRYAFATAHIHGEIYRRRGWLTSEGKEIKNK

DEILALLKALFLPKRLSIIHCPGHQKGHSAEARGNRMADQAARKAAITET

PDTSTLLIENSSF*SGGS**KRTADGSEFEPKKKRK*

Prime Editor Packages in a Dual AAV System

Prime editors split between residues 1023 and 1024 with Npu trans-splicing intein become packages within AAV with high titer comparable to that of base editors of similar genome size produced in the same manner.

Prime Editing In Vivo

Split SpPE3 delivered with AAV9 by intracerebroventricular injection to P0 mice mediates prime editing in brain tissue in vivo. A nucleotide substitution at position +5 (i.e., 5 nucleotide bases downstream of nick site and within the PAM sequence) of a G-to-T results in the installation of a Pro>Gln coding mutation near the N terminus of DNMT1. This edit demonstrates the viability of prime editing in vivo and is not thought to introduce any selective pressure on edited cells (with "+5" referring to the +5 position downstream of the nick site). The AAV architectures tested include a full-length MMLV RT as well as a truncated variant lacking the RNAse H domain. The truncated post-transcriptional regulatory element W3 was also assessed as it has been shown to increase expression from viral cassettes in vivo but its importance had not been tested in the context of base editors or prime editors. It was found that full-length RT outperforms truncated RT, and the addition of the W3 sequence improves activity. The increase in editing activity when W3 is present indicates that expression of prime editor is limiting in vivo and demonstrates the distinct challenges of prime editing in vivo versus cell culture.

References

Oakes, B. L., Fellmann, C. et al. CRISPR-Cas9 Circular Permutants as Programmable Scaffolds for Genome Modification. Cell. 2019 Jan. 10; 176(1-2):254-267.e16. doi: 10.1016/j.cell.2018.11.052.

Example 21. Linker Optimization in Pe2 Format

This Example constructed a number of variant prime editors all based on PE2. PE2 has the following sequence and structure:

As used herein, "PE2" refers to a PE complex comprising a fusion protein comprising Cas9(H840A) and a variant MMLV RT having the following structure: [NLS]-[Cas9(H840A)]-[linkerHMMLV_RT(D200N)(T330P)(L603W)(T306K)(W313F)]+a desired PEgRNA, wherein the PE fusion has the amino acid sequence of SEQ ID NO: 134, which is shown as follows:

(SEQ ID NO: 134)
MKRTADGSEFESPKKKRKVDKKYSIGLDIGTNSVGWAVITDEYKVPSKKF

KVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKY

PTIYHLRKKLVDSTDKADLRLIYLALAHMIKFRGHFLIEGDLNPDNSDVD

KLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQI

GDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTE

GMRKPAFLSGEQKKAIVDLLFKTNRKVTVKQLKEDYFKKIECFDSVEISG

VEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDF

-continued
LKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMK

RIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHVA

QILDSRMNTKYDENDKLIREVKVITLKSKLVSDFRKDFQFYKVREINNYH

HAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFAT

VRKVLSMPQVNIVKKTEVQTGGFSKESILPKRNSDKLIARKKDWDPKKYG

GFDSPTVAYSVLVVAKVEKGKSKKLKSVKELLGITIMERSSFEKNPIDFL

-continued
EAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVIL

ADANLDKVLSAYNKHRDKPIREQAENIIHLFTLTNLGAPAAFKYFDTTID

RKRYTSTKEVLDATLIHQSITGLYETRIDLSQLGGD<u>SGGSSGGSSGSETP</u>

<u>GTSESATPESSGGSSGGSS</u>TLNIEDEYRLHETSKEPDVSLGSTWLSDFPQ

AWAETGGMGLAVRQAPLIIPLKATSTPVSIKQYPMSQEARLGIKPHIQRL

LDQGILVPCQSPWNTPLLPVKKPGTNDYRPVQDLREVNKRVEDIHPTVPN

PYNLLSGLPPSHQWYTVLDLKDAFFCLRLHPTSQPLFAFEWRDPEMGISG

QLTWTRLPQGFKNSPTLFNEALHRDLADFRIQHPDLILLQYVDDLLLAAT

SELDCQQGTRALLQTLGNLGYRASAKKAQICQKQVKYLGYLLKEGQRWLT

EARKETVMGQPTPKTPRQLREFLGKAGFCRLFIPGFAEMAAPLYPLTKPG

TLFNWGPDQQKAYQEIKQALLTAPALGLPDLTKPFELFVDEKQGYAKGVL

-continued
TQKLGPWRRPVAYLSKKLDPVAAGWPPCLRMVAAIAVLTKDAGKLTMGQP

LVILAPHAVEALVKQPPDRWLSNARMTHYQALLLDTDRVQFGPVVALNPA

TLLPLPEEGLQHNCLDILAEAHGTRPDLTDQPLPDADHTWYTDGSSLLQE

GQRKAGAAVTTETEVIWAKALPAGTSAQRAELIALTQALKMAEGKKLNVY

TDSRYAFATAHIHGEIYRRRGWLTSEGKEIKNKDEILALLKALFLPKRLS

IIHCPGHQKGHSAEARGNRMADQAARKAAITETPDTSTLLIENSS<u>PSGGS</u>

<u>KRTADGSEFEPKKKRKV</u>

The PE2 linker is SGGSSGGSSGSETPGTSESAT-PESSGGSSGGSS (SEQ ID NO: 127).

In this experiment, the linker of PE2 was replaced with one of the following substitute linkers (or no linker in one instance):

| Linker Name | Nucleotide Sequence | Amino Acid Sequence |
|---|---|---|
| 1x SGGS | TCCGGAGGATCT (SEQ ID NO: 3880) | SGGS (SEQ ID NO: 174) |
| 2x SGGS | TCCGGAGGATCTAGCGGAGGCTCC (SEQ ID NO: 3881) | SGGSSGGS (SEQ ID NO: 446) |
| 3x SGGS | TCCGGAGGATCTAGCGGAGGCTCCAGCGGAGGCAGC (SEQ ID NO: 3882) | SGGSSGGSSGGS (SEQ ID NO: 3889) |
| 1x XTEN | TCTGGCTCTGAGACACCTGGCACAAGCGAGAGCGCAACACCTGAAAGC (SEQ ID NO: 3883) | SGSETPGTSESATPES (SEQ ID NO: 171) |
| No linker | | |
| 1x Gly | GGT | G |
| 1x Pro | CCC | P |
| 1x EAAAK | GAAGCAGCTGCTAAA (SEQ ID NO: 3884) | EAAAK (SEQ ID NO: 3968) |
| 2x EAAAK | GAAGCCGCTGCTAAAGAAGCTGCAGCTAAG (SEQ ID NO: 3885) | EAAAKEAAAK (SEQ ID NO: 3969) |
| 3x EAAAK | GAAGCCGCTGCTAAAGAGGCCGCTGCTAAAGAAGCTGCAGCTAAG (SEQ ID NO: 3886) | EAAAKEAAAKEAAAK (SEQ ID NO: 3970) |

FIG. 79 shows the editing efficiency of the replacement linker constructs. In particular, the data shows the editing efficiency of the PE2 construct with the current linker (noted as PE2—white box) compared to various versions with the linker replaced with a sequence as indicated at the HEK3, EMX1, FANCF, RNF2 loci for representative PEgRNAs for transition, transversion, insertion, and deletion edits. The replacement linkers are referred to as "1×SGGS" (SEQ ID NO:174), "2×SGGS" (SEQ ID NO: 446), "3×SGGS" (SEQ ID NO: 3889), "1×XTEN" (SEQ ID NO: 171), "no linker", "1×Gly", "1×Pro", "1×EAAAK" (SEQ ID NO: 3968), "2×EAAAK" (SEQ ID NO: 3969), and "3×EAAAK" (SEQ ID NO: 3970). The editing efficiency is measured in bar graph format relative to the "control" editing efficienty of PE2. The linker of PE2 is SGGSSGGSSGSETPGTSESAT-PESSGGSSGGSS (SEQ ID NO: 127). All editing was done in the context of the PE3 system, i.e., which refers the PE2 editing construct plus the addition of the optimal secondary sgRNA nicking guide.

FIG. 80. shows that the 1×XTEN (SEQ ID NO: 171) linker provided an increase in editing efficiency. Taking the average fold efficacy relative to PE2 yields the graph shown, indicating that use of a 1×XTEN (SEQ ID NO: 171) linker sequence improves editing efficiency by 1.14 fold on average (n=15).

Example 22. Prime Editor Guide RNAs with Improved Activities

In various embodiments, PEgRNA are likely to be target DNA site and edit dependent. That is, the sequence of the PEgRNA will depend upon the target DNA sequence and the particular edit that is being introduced therein by prime editing (e.g., deletion, insertion, inversion, substitution). For instance, in certain embodiments, when attaching a motif 3' of the primer binding site (PBS) of the PEgRNA, a linker between the PBS and motif is preferred to prevent steric clash with the polymerase domain (e.g., reverse transcriptase) of the PE fusion protein. However, the nature of that linker may be different for each site. For instance, if the same linker for each site were used, it could artificially render a 13 nt PBS a 16 nt PBS by fortuitous pairing to the spacer sequence. Similarly, the linker could basepair to the PBS itself, resulting in its occlusion and potentially reducing activity. So, unlike with protein-based editors, such as PE or BE4, a single linker sequence option connecting two elements may not be effective in each construct but will depend in part on the sequence of the target DNA sequence and the edit of interest.

Building, in part, on the information presented Example 15 (Design and Engineering of PEgRNAs), this Example constructed and then tested the effects of various structural modifications made to PEgRNA on editing function, among other aspects.

Expression of PEgRNAs from Non-Pol III Promoters

A variety of PEgRNA expression systems were tested for their ability to generate PEgRNAs, using insertion of a 102 nucleotide sequence from FKBP as a readout.

Transcription of PEgRNA can be directed by a typical constitutive promoter, such as U6 promoter. Although the U6 promoter is in most cases effective at directing transcription of PEgRNAs, the U6 promoter is not very effective at directing the transcription of longer PEgRNAs or U-rich RNAs. U-rich RNA stretches of cause premature termination of transcription. This Example compared editing outcomes of guides expressed from the CMV promoter or U1 promoter with the U6 promoter. These promoters require a different terminator sequence, such as MASC ENE or PAN ENE, as provided below. An increase in editing was observed with the pCMV/MASC-ENE system, however these guides resulted in incomplete insertion of the sequence, while, with the U6 promoter, complete insertion was observed at lower levels of editing. See FIG. 81. The data suggests the likelihood that the alternate expression systems may be useful for long insertions.

The nucleotide sequence of the pCMV/MASC-ENE expression systems as follows (5'-to-3' direction) (with the name of the motif in bold immediately preceding the region to which it refers):
—pCMV Promoter—

(SEQ ID NO: 3971)
TAGTTATTAATAGTAATCAATTACGGGGTCATTAGTTCATAGCCCATATA

TGGAGTTCCGCGTTACATAACTTACGGTAAATGGCCCGCCTGGCTGACCG

CCCAACGACCCCCGCCCATTGACGTCAATAATGACGTATGTTCCCATAGT

-continued

AACGCCAATAGGGACTTTCCATTGACGTCAATGGGTGGAGTATTTACGGT

AAACTGCCCACTTGGCAGTACATCAAGTGTATCATATGCCAAGTACGCCC

CCTATTGACGTCAATGACGGTAAATGGCCCGCCTGGCATTATGCCCAGTA

CATGACCTTATGGGACTTTCCTACTTGGCAGTACATCTACGTATTAGTCA

TCGCTATTACCATGGTGATGCGGTTTTGGCAGTACATCAATGGGCGTGGA

TAGCGGTTTGACTCACGGGGATTTCCAAGTCTCCACCCCATTGACGTCAA

TGGGAGTTTGTTTTGGCACCAAAATCAACGGGACTTTCCAAAATGTCGTA

ACAACTCCGCCCCATTGACGCAAATGGGCGGTAGGCGTGTACGGTGGGAG

GTCTATATAAGCAGAGCTGGTTTAGTGAACCGTCAGATC-Csy4 loop-

GTTCACTGCCGTATAGGCAG-spacer-GGCCCAGACTGAGCACGTGA- scaffold-GTTTTAGAGCTAGAAATAGCAAGTTAAAATAAGGCTAGTCC

GTTATCAACTTGAAAAAGTGGGACCGAGTCGGTCC-template-TGGAG

GAAGCAGGGCTTCCTTTCCTCTGCCATCA-insert-AAATTTCTTTCCA

TCTTCAAGCATCCCGGTGTAGTGCACCACGCAGGTCTGGCCGCGCTTGGG

GAAGGTGCGCCCGTCTCCTGGGGAGATGGTTTCCACCTGCACTCC-PBS-

CGTGCTCAGTCTG-linker-TTT-MASC ENE-TAGGGTCATGAAGGTT

TTTCTTTTCCTGAGAAAACAACACGTATTGTTTTCTCAGGTTTTGCTTTT

TGGCCTTTTTCTAGCTTAAAAAAAAAAAAAGCAAAAGATGCTGGTGGTTG

GCACTCCTGGTTTCCAGGACGGGGTTCAAATCCCTGCGGCGTCTTTGCTT

TGACT-unrelated plasmid sequence-TTTTTTTAAGCTTGGGC

CGCTCGAGGTAGCAGC-Ubc promoter-GGCCTCCGCGCCGGGTTTTG

GCGCCTCCCGCGGGCGCCCCCCTCCTCACGGCGAGCGCTGCCACGTCAGA

CGAAGGGCGCAGGAGCGTTCCTGATCCTTCCGCCCGGACGCTCAGGACAG

CGGCCCGCTGCTCATAAGACTCGGCCTTAGAACCCCAGTATCAGCAGAAG

GACATTTTAGGACGGGACTTGGGTGACTCTAGGGCACTGGTTTTCTTTCC

AGAGAGCGGAACAGGCGAGGAAAAGTAGTCCCTTCTCGGCGATTCTGCGG

AGGGATCTCCGTGGGCGGTGAACGCCGATGATTATATAAGGACGCGCCG

GGTGTGGCACAGCTAGTTCCGTCGCAGCCGGGATTTGGGTCGCGGTTCTT

GTTTGTGGATCGCTGTGATCGTCACTTGGTGAGTTGCGGGCTGCTGGGCT

GGCCGGGGCTTTCGTGGCCGCCGGGCCGCTCGGTGGGACGGAAGCGTGTG

GAGAGACCGCCAAGGGCTGTAGTCTGGGTCCGCGAGCAAGGTTGCCCTGA

ACTGGGGGTTGGGGGAGCGCACAAAATGGCGGCTGTTCCCGAGTCTTGA

ATGGAAGACGCTTGTAAGGCGGGCTGTGAGGTCGTTGAAACAAGGTGGGG

GGCATGGTGGGCGGCAAGAACCCAAGGTCTTGAGGCCTTCGCTAATGCGG

GAAAGCTCTTATTCGGGTGAGATGGGCTGGGGCACCATCTGGGGACCCTG

ACGTGAAGTTTGTCACTGACTGGAGAACTCGGGTTTGTCGTCTGGTTGCG

GGGGCGGCAGTTATGCGGTGCCGTTGGGCAGTGCACCCGTACCTTTGGGA

GCGCGCGCCTCGTCGTGTCGTGACGTCACCCGTTCTGTTGGCTTATAATG

CAGGGTGGGGCCACCTGCCGGTAGGTGTGCGGTAGGCTTTTCTCCGTCGC

AGGACGCAGGGTTCGGGCCTAGGGTAGGCTCTCCTGAATCGACAGGCGCC

-continued

```
GGACCTCTGGTGAGGGGAGGGATAAGTGAGGCGTCAGTTTCTTTGGTCGG

TTTTATGTACCTATCTTCTTAAGTAGCTGAAGCTCCGGTTTTGAACTATG

CGCTCGGGGTTGGCGAGTGTGTTTTGTGAAGTTTTTTAGGCACCTTTTGA

AATGTAATCATTTGGGTCAATATGTAATTTTCAGTGTTAGACTAGTAAAT

TGTCCGCTAAATTCTGGCCGTTTTTGGCTTTTTTGTTAGACAGGATCCCC

GGGTACCGGTCGCCACC-Csy4 and NLS-ATGGGCTCTTTTACTATGG

ACCACTACCTGGATATTAGACTGAGACCTGACCCTGAGTTCCCACCCGCC

CAGCTGATGAGCGTGCTGTTCGGCAAGCTGCACCAGGCCCTGGTGGCACA

GGGAGGCGACCGGATCGGCGTGAGCTTCCCCGACCTGGATGAGAGCAGAT

CCAGGCTGGGAGAGCGCCTGAGGATCCACGCATCCGCCGACGATCTGCGC

GCCCTGCTGGCCCGGCCATGGCTGGAGGGCCTGCGCGACCACCTGCAGTT

TGGAGAGCCAGCAGTGGTGCCACACCCTACCCCATACAGGCAGGTGTCCA

GGGTGCAGGCAAAGTCTAACCCTGAGCGGCTGCGGAGAAGGCTGATGCGC

CGGCACGATCTGTCTGAGGAGGAGGCCAGAAAGAGGATCCCCGACACCGT

GGCCAGAACACTGGATCTGCCTTTCGTGACCCTGCGGAGCCAGAGCACAG

GCCAGCACTTCAGACTGTTTATCAGGCACGGCCCACTGCAGGTGACAGCC

GAGGAAGGAGGATTCACTTGTTACGGACTGTCTAAAGGAGGATTCGTGCC

CTGGTTCAGCAGCCTGAGGCCTCCTAAGAAGAAGAGGAAGGTTTAA-

SV40 terminator-TGATCATAATCAAGCCATATCACATCTGTAGAGG

TTTACTTGCTTTAAAAAACCTCCACACCTCCCCCTGAACCTGAAACATAA

AATGAATGCAATTGTTGTTGTTAACTTGTTTATTGCAGCTTATAATGGTT

ACAAATAAAGCAATAGCATCACAAATTTCACAAATAAAGCATTTTTTTCA

CTGCATTCTAGTTGTGGTTTGTCCAAACTCATCAATGTATCTTATCATGT

CTGGATCTGC
```

Key:
[pCMV promoter]—binds pol II RNA polymerase
[Csy4 loop]—bound by Csy4 protein, results in cleavage 3' of the loop. Required because part of [CMV promoter] is transcribed, and if this sequence is attached 5' of the gRNA it will lower/eliminate activity (previously known).
[Spacer sequence] of pegRNA
[pegRNA scaffold]
[DNA synthesis template]
[insertion edit (108 nt from FKBP)]
[primer binding site]
[Linker] (highly variable)—connects PBS and terminator element
[MASC ENE transcription terminator]—transcription of this element results in termination of transcription; a polyA tail is encoded and then sequestered by the ENE element
[Unimportant sequence]
[Ubc promoter]—required for expression of the Csy4 protein
[Csy4 protein and NLS]—required for processing of the 5' end of the guide. Other strategies could also be used that don't require expression of a large protein (such as ribozyme-mediated cleavage of the spacer), but these would require more individual tuning for different spacer sequences, so we used this.
[SV40 terminator]—for termination of the Csy4 protein.

Improvements to the PEgRNA Scaffold

A number of structural modifications to the gRNA scaffold were also tested, none of which showed a significant increase in editing activity (see FIG. 82 at 3.30.13 through 3.30.19 inin the X axis, as compare to 3.30). However, this data has two caveats worth noting. First, this guide already worked quite well, and a less effective guide would have been better to test. Second, in HEK cells, transfection is quite efficient, and it was noted that the amount of guide RNA transfected is in large excess compared to what is needed (reducing the amount by ~4-8 fold has no effect on editing). These improvements might only be seen in other cell types, where transfection efficiency is lower, or with less effective guides. Many of these changes are precedented to improve sgRNA activity in other cell lines.

The sequences of the constructs of FIG. 82 are as follows:

```
HEK3.30 pegRNA sequence:
                                                    [SEQ ID NO: 3972]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAAAGCGUGCUCAGUCUG-Terminal motif-UUUU

HEK3.30.0 pegRNA sequence:
                                                    [SEQ ID NO: 3874]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAAAGCGUGCUCAGUCUG-Terminal motif-UUUUUU

HEK3.30.1 pegRNA sequence:
                                                    [SEQ ID NO: 3973]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAAAGCGUGCUCAGUCUG-Terminal motif-[none]
```

-continued

HEK3.30.2 pegRNA sequence:
[SEQ ID NO: 3974]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUGCUCGAGGCGGAAACGCCUCGAGCUUUU HEK3.30.2b pegRNA sequence:
[SEQ ID NO: 3975]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUGCUCGAGGCGGAAACGCCUCGAGC HEK3.30.3 pegRNA sequence:
[SEQ ID NO: 3976]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUGCUCGAGGCGUACGCGAAAGCGUACGCCUCGAGCUUUU HEK3.30.3b pegRNA sequence:
[SEQ ID NO: 3977]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUGCUCGAGGCGUACGCGAAAGCGUACGCCUCGAGC HEK3.30.5 pegRNA sequence:
[SEQ ID NO: 3978]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUGCUCGAGGCGUACGCCCGAUGAAAAUCGGGCGUACGCCUCGAGCUUUU HEK3.30.5a pegRNA sequence:
[SEQ ID NO: 3979]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS-
UCUGCCAUCAAAGCGUGCUCAGUCUG-Terminal motif-
UUUUGGGGUUGGGGUUGGGGUUGGGGUUUU HEK3.30.5b pegRNA sequence:
[SEQ ID NO: 3980]
spacer-GGCCCAGACUGAGCACGUGA-scaffold-
GUUUUAGAGCUAGAAAUAGCAAGUUAAAAUAAGGCUAGUCCGUUAUCAACU
UGAAAAAGUGGCACCGAGUCGGUGC-Template and PBS- -continued UCUGCCAUCAAAGCGUGCUCAGUCUG-Terminal motif-

UUUGGUGGUGGUGGUUUU

HEK3.30.13 pegRNA sequence:
[SEQ ID NO: 3981]
spacer-GGCCCAGACUGAGCACGUGA-scaffold-

GUUUUAGAGCUAGCGAAAGCUAGCAAGUUAAAAUAAGGCUAGUCCGUUAUC

AACUUGAAAAAGUGGGACCGAGUCGGUCC-Template and PBS-

UCUGCCAUCAAAGCGUGCUCAGUCUG-Terminal motif-UUUU

HEK3.30.15 pegRNA sequence:
[SEQ ID NO: 3982]
spacer-GGCCCAGACUGAGCACGUGA-scaffold-

GUUUUAGAGCUAGCUCGAAAGAGCUAGCAAGUUAAAAUAAGGCUAGUCCGU

UAUCAACUUGAAAAAGUGGGACCGAGUCGGUCC-Template and PBS-

UCUGCCAUCAAAGCGUGCUCAGUCUG-Terminal motif-UUUU

HEK3.30.15 pegRNA sequence:
[SEQ ID NO: 3983]
spacer-GGCCCAGACUGAGCACGUGA-scaffold-

GUUUUAGAGCUAGCUCAUGAAAAUGAGCUAGCAAGUUAAAAUAAGGCUAGU

CCGUUAUCAACUUGAAAAAGUGGGACCGAGUCGGUCC-Template and PBS-

UCUGCCAUCAAAGCGUGCUCAGUCUG-Terminal motif-UUUU

HEK3.30.16 pegRNA sequence:
[SEQ ID NO: 3984]
spacer-GGCCCAGACUGAGCACGUGA-scaffold-

GUUUUAGAGCUAGCUCAUCCGAAAGGAUGAGCUAGCAAGUUAAAAUAAGGC

UAGUCCGUUAUCAACUUGAAAAAGUGGGACCGAGUCGGUCC-Template and

PBS-UCUGCCAUCAAAGCGUGCUCAGUCUG-Terminal motif-UUUU

HEK3.30.17 pegRNA sequence:
[SEQ ID NO: 3985]
spacer-GGCCCAGACUGAGCACGUGA-scaffold-

GUUUUAGAGCUAGCUCAUCCUGGAAACAGGAUGAGCUAGCAAGUUAAAAUA

AGGCUAGUCCGUUAUCAACUUGAAAAAGUGGGACCGAGUCGGUCC-Template and PBS-UCUGCCAUCAAAGCGUGCUCAGUCUG-Terminal motif-UUUU HEK3.30.18 pegRNA sequence:
[SEQ ID NO: 3986]
spacer-GGCCCAGACUGAGCACGUGA-scaffold-

GUUUGAGAGCUAGAAAUAGCAAGUUUAAAUAAGGCUAGUCCGUUAUCAACU

UGAAAAAGUGGGACCGAGUCGGUCC-Template and PBS-

UCUGCCAUCAAAGCGUGCUCAGUCUG-Terminal motif-UUUU

HEK3.30.19 pegRNA sequence:
[SEQ ID NO: 3987]
spacer-GGCCCAGACUGAGCACGUGA-scaffold-

GUUUGAGAGCUAGCUCAUGAAAAUGAGCUAGCAAGUUUAAAUAAGGCUAGU

CCGUUAUCAACUUGAAAAAGUGGGACCGAGUCGGUCC-Template and PBS-

UCUGCCAUCAAAGCGUGCUCAGUCUG-Terminal motif-UUUU

HEK3.56 pegRNA sequence:
[SEQ ID NO: 3890]
spacer-GGCCCAGACUGAGCACGUGA-scaffold-

GUUUUAGAGCUAGAAAUAGCAAGUUAAAAUAAGGCUAGUCCGUUAUCAACU

-continued

UGAAAAAGUGGCACCGAGUCGGUGC-Template and PBS-

UCUGCCAUCAAAGCUUCGACCGUGCUCAGUCUG-Terminal motif-UUUU

HEK3.56.1a pegRNA sequence:
[SEQ ID NO: 3891]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGGCGAAAGCCUCGUGCUCAGUCUG-Terminal motif-UUUU

HEK3.56.1b pegRNA sequence:
[SEQ ID NO: 3988]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGACGAAAGCCUCGUGCUCAGUCUG-Terminal motif-UUUU

HEK3.56.1c pegRNA sequence:
[SEQ ID NO: 3892]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGGCGAAAGCCCGUGCUCAGUCUG-Terminal motif-UUUU

HEK3.56.2a pegRNA sequence:
[SEQ ID NO: 3893]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGAUGCGAAAGCAUCUCGUGCUCAGUCUG-Terminal motif-UUUU

HEK3.56.2b pegRNA sequence:
[SEQ ID NO: 3894]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGAUGCGAAAGCACCUCGUGCUCAGUCUG-Terminal motif-UUUU

HEK3.56.2c pegRNA sequence:
[SEQ ID NO: 3895]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGAUGCGAAAGCAUCCGUGCUCAGUCUG-Terminal motif-UUUU

HEK3.56.3a pegRNA sequence:
[SEQ ID NO: 3896]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGACAUGCGAAAGCAUGUCUCGUGCUCAGUCUG-Terminal motif-

UUUU

HEK3.56.3b pegRNA sequence:
[SEQ ID NO: 3897]
spacer-GGCCCAGACUGAGCACGUGA-scaffold- -continued

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGACAUGCGAAAGCAGGCCCGUGCUCAGUCUG-Terminal motif-

UUUU

HEK3.56.3c pegRNA sequence:
[SEQ ID NO: 3898]
spacer-GGCCCAGACUGAGCACGUGA-scaffold-

GUUUUAGAGCUAGAAAUAGCAAGUUAAAAUAAGGCUAGUCCGUUAUCAACU

UGAAAAAGUGGCACCGAGUCGGUGC-Template and PBS-

UCUGCCAUCAGACAUGCGAAAGCAUGUCUCGUGCUCAGUCUG-Terminal motif-

UUUU

HEK3.56.4a pegRNA sequence:
[SEQ ID NO: 3899]
spacer-GGCCCAGACUGAGCACGUGA-scaffold-

GUUUUAGAGCUAUACGUAGCAAGUUAAAAUAAGGCUAGUCCGUUAUCAACU

UUACGAAGUGGGACCGAGUCGGUCC-Template and PBS-

UCUGCCAUCAAAGCUUCGACCGUGCUCAGUCUG-Terminal motif-UUUU

HEK3.56.4b pegRNA sequence:
[SEQ ID NO: 3989]
5'motif-

GCAGACCUAAGUGGUGACAUAUGGUCUG-spacer-

GGCCCAGACUGAGCACGUGA-scaffold-

GUUUUAGAGCUAUACGUAGCAAGUUAAAAUAAGGCUAGUCCGUUAUCAACU

UUACGAAGUGGGACCGAGUCGGUCC-Template and PBS--Terminal motif-UUUU

HEK3.56.4c pegRNA sequence:
[SEQ ID NO: 3900]
5'motif-

GCAGACCUAAGUGGUGACAUAUGGUCUG-spacer-

GGCCCAGACUGAGCACGUGA-scaffold-

GUUUUAGAGCUAUACGUAGCAAGUUAAAAUAAGGCUAGUCCGUUAUCAACU

UUACGAAGUGGGACCGAGUCGGUCC-Template and PBS--Terminal motif-UUUU

HEK3.56.4d pegRNA sequence:
[SEQ ID NO: 3901]
5'motif-

GCAGACCUAAGUGGUGACAUAUGGUCUG-spacer-

GGCCCAGACUGAGCACGUGA-scaffold-

GUUUUAGAGCUAUACGUAGCAAGUUAAAAUAAGGCUAGUCCGUUAUCAACU

UUACGAAGUGGGACCGAGUCGGUCC-Template and PBS--Terminal motif-UUUU

Note that where ever either no terminal motif or a terminal motif that does not end in a run of U's exists, transcript was terminated using the following HDV ribozyme:

[SEQ ID NO: 3990]
GGCCGGCAUGGUCCCAGCCUCCUCGCUGGCGCCGGCUGGGCAACAUGCUU

CGGCAUGGCGAAUGGGAC

Additional RNA Motifs

See FIG. 82 for details on certain motifs, such as an HDV ribozyme 3' of the PEgRNA, or G-quadruplex insertion, P1 extensions, template hairpins, and tetraloop circ'd, that may be introduced into a PEgRNA to improve its performance.

In particular, this Example tested the effect of intalling a tRNA motif 3' of the primer binding site. This element was chosen because of multiple potential functions:

(1) the tRNA motif is a very stable RNA motif, and so could potentially reduce PEgRNA degradation;

(2) the MMLV RT uses a prolyl-tRNA as a primer when converting the viral genome into DNA during transcription, so it was suspected the same cap could be bound by the RT, improving binding of the PEgRNA by PE, RNA stability, and bringing the PBS back in closer proximity to the genomic site, potentially also improving activity.

In these constructs, the P1 of the tRNA (see FIG. 84) was extended. P1 refers to the first stem/base-pairing element of the tRNA (see FIG. 84). This was believed to be necessary to prevent RNAseP-mediated cleavage of the tRNA 5' of the P1, which would result in its removal from the PEgRNA.

In this design a prolyl-tRNA (codon CGG) with an extended P1 and short 3 nt linker between the tRNA and the PBS was used. A variety of tRNA designs were tested and the editign efficiency was tested compared to a PEgRNA having no tRNA cap—see the comparative data in FIG. 83 (depicting a PE experiment that targeted editing of the HEK3 gene, specifically targeting the insertion of a 10 nt insertion at position +1 relative to the nick site and using PE3), FIG. 85 (depicting a PE experiment that targeted editing of the FANCF gene, specifically targeting a G-to-T conversion at position +5 relative to the nick site and using PE3 construct) and FIG. 86 (depicting a PE experiment that targeted editing of the HEK3 gene, specifically targeting the insertion of a 71 nt FLAG tag insertion at position +1 relative to the nick site and using PE3 construct). tRNA-modified PEgRNAs were tested against a non-modified PEgRNA control.

UGG/CGG refers to the codon used, the number refers to the length of the added P1 extension, long indicates an 8 nt linker, no designation a 3 nt linker.

The data suggest that the installation of a tRNA may enable use of shorter PBSs, which would likely result in additional activity improvements. In the case of RNF2, it is possible/likely that the linker used resulted in improved PBS binding to the spacer, and the resulting diminishment in activity.

Some sequences used:
HEK3 +1 FLAG-Tag Insertion, proly-tRNA{UGG} P1 EXT 5 nt, Linker 3 nt

[SEQ ID NO: 3902]
GGCCCAGACUGAGCACGUGAGUUUUAGAGCUAGAAAUAGCAAGUUAAAAU

AAGGCUAGUCCGUUAUCAACUUGAAAAAGUGGCACCGAGUCGGUGCUGGA

GGAAGCAGGGCUUCCUUUCCUCUGCCAUCACUUAUCGUCGUCAUCCUUGU

AAUCCGUGCUCAGUCUGUCGGCGGGCUCGUUGGUCUAGGGGUAUGAUU

CUCGCUUCGGGUGCGAGAGGUCCCGGGUUCAAAUCCCGGACGAGCCCCGC

CUUUU

FANCF +5 G to T proly-tRNA{CGG} P1 ext 5 nt, Linker 3 nt

[SEQ ID NO: 3903]
GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGAUCUGGCGGGGCUCGUUGGUCUAGG

GGUAUGAUUCUCGCUUCGGGUGCGAGAGGUCCCGGGUUCAAAUCCCGGAC

GAGCCCCGCCUUUU

HEK3 ++1 10 nt Insertion, proly-tRNA{UGG} P1 ext 5 nt, Linker 3 nt

[SEQ ID NO: 3904]
GGCCCAGACUGAGCACGUGAGUUUUAGAGCUAGAAAUAGCAAGUUAAAAU

AAGGCUAGUCCGUUAUCAACUUGAAAAAGUGGGACCGAGUCGGUCCUCUG

CCAUCAAAGCUUCGACCGUGCUCAGUCUUCUGCUCGAGGCGGGGCUCGUU

GGUCUAGGGGUAUGAUUCUCGCUUCGGGUGCGAGAGGUCCCGGGUUCAAA

UCCCGGACGAGCCCCGCCUCGAGCUUUU

The sequences reported in the data of FIGS. 85 and 86 are as follows:

FANCF +5 G to T pegRNA sequence:
[SEQ ID NO: 3905]
pace, scaffold template and PBSr-

GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGA-partial CGG tRNA linker

8-UCUCUCUCUGGUCUAGGGGUAUGAUUCUCGCUUCGGGUGCGAGAGGUC

CCGGGUUCAAUUUU

FANCF +5 G to T pegRNA sequence:
[SEQ ID NO: 3906]
space, scaffold template and PBSr-

GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGA-UGG P1 ext 5 linker 3-U

CUGGCGGGGCUCGUUGGUCUAGGGGUAUGAUUCUCGCUUUGGGUGCGAGA

GGUCCCGGGUUCAAAUCCCGGACGAGCCCCGCCUUUU

FANCF +5 G to T pegRNA sequence:
[SEQ ID NO: 3907]
space, scaffold template and PBSr-

GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGA-UGG P1 ext 5 linker 8-U

CUCUCUCGGCGGGCUCGUUGGUCUAGGGGUAUGAUUCUCGCUUUGGGUG

CGAGAGGUCCCGGGUUCAAAUCCCGGACGAGCCCCGCCUUUU

FANCF +5 G to T pegRNA sequence:
[SEQ ID NO: 3908]
space, scaffold template and PBSr-

GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGA-UGG P1 ext 8 linker 3-U

CUCGAGGCGGGGCUCGUUGGUCUAGGGGUAUGAUUCUCGCUUUGGGUGCG

AGAGGUCCCGGGUUCAAAUCCCGGACGAGCCCCGCCUCGUUUU

FANCF +5 G to T pegRNA sequence:
[SEQ ID NO: 3909]
space, scaffold template and PBSr-
GGAAUCCCUUCUGCAGCACCGUUUUAGAGCUAGAAAUAGCAAGUUAAAAU

AAGGCUAGUCCGUUAUCAACUUGAAAAAGUGGCACCGAGUCGGUGCGGAA

AAGCGAUCAAGGUGCUGCAGAAGGGA-UGG P1 ext 8 linker 8-U

CUCUCUCCGAGGCGGGGCUCGUUGGUCUAGGGGUAUGAUUCUCGCUUUGG

GUGCGAGAGGUCCCGGGUUCAAAUCCCGGACGAGCCCCGCCUCGUUUU

FANCF +5 G to T pegRNA sequence:
[SEQ ID NO: 3910]
space, scaffold template and PBSr-
GGAAUCCCUUCUGCAGCACCGUUUUAGAGCUAGAAAUAGCAAGUUAAAAU
AAGGCUAGUCCGUUAUCAACUUGAAAAAGUGGCACCGAGUCGGUGCGGAA
AAGCGAUCAAGGUGCUGCAGAAGGGA-UGG P1 ext 11 linker 3-
UCUGCUCGAGGCGGGGCUCGUUGGUCUAGGGGUAUGAUUCUCGCUUUGGG
UGCGAGAGGUCCCGGGUUCAAAUCCCGGACGAGCCCCGCCUCGAGCUUUU FANCF +5 G to T pegRNA sequence:
[SEQ ID NO: 3911]
space, scaffold template and PBSr-
GGAAUCCCUUCUGCAGCACCGUUUUAGAGCUAGAAAUAGCAAGUUAAAAU
AAGGCUAGUCCGUUAUCAACUUGAAAAAGUGGCACCGAGUCGGUGCGGAA
AAGCGAUCAAGGUGCUGCAGAAGGGA-UGG P1 ext 11 linker 8-
UCUCUCUCGCUCGAGGCGGGGCUCGUUGGUCUAGGGGUAUGAUUCUCGCU
UUGGGUGCGAGAGGUCCCGGGUUCAAAUCCCGGACGAGCCCCGCCUCGAG
CUUUU HEK3 +1 10 nt insertion pegRNA sequence:
[SEQ ID NO: 3913]
space, scaffold template and PBSr-
GGCCCAGACTGAGCACGTGAGTTTTAGAGCTAGAAATAGCAAGTTAAAAT
AAGGCTAGTCCGTTATCAACTTGAAAAAGTGGCACCGAGTCGGTGCTCTG
CCATCAAAGCTTCGACCGTGCTCAGTCTG-UGG P1 ext 5 linker
3-UCUGGCGGGGCUCGUUGGUCUAGGGGUAUGAUUCUCGCUUUGGGUGCG
AGAGGUCCCGGGUUCAAAUCCCGGACGAGCCCCGCCUUUU HEK3 +1 FLAG insertion pegRNA sequence:
[SEQ ID NO: 3914]
space, scaffold template and PBSr-
GGCCCAGACUGAGCACGUGAGUUUUAGAGCUAGAAAUAGCAAGUUAAAAU
AAGGCUAGUCCGUUAUCAACUUGAAAAAGUGGCACCGAGUCGGUGCUGGA
GGAAGCAGGGCUUCCUUUCCUCUGCCAUCACUUAUCGUCGUCAUCCUUGU
AAUCCGUGCUCAGUCUG-partial CGG tRNA linker 8-UCUCUC
UCUGGUCUAGGGGUAUGAUUCUCGCUUCGGGUGCGAGAGGUCCCGGGUUC
AAUUUU HEK3 +1 FLAG insertion pegRNA sequence:
[SEQ ID NO: 3915]
space, scaffold template and PBSr-
GGCCCAGACUGAGCACGUGAGUUUUAGAGCUAGAAAUAGCAAGUUAAAAU
AAGGCUAGUCCGUUAUCAACUUGAAAAAGUGGCACCGAGUCGGUGCUGGA
GGAAGCAGGGCUUCCUUUCCUCUGCCAUCACUUAUCGUCGUCAUCCUUGU
AAUCCGUGCUCAGUCUG-UGG P1 ext 5 linker 3-UCUGGCGGGG
CUCGUUGGUCUAGGGGUAUGAUUCUCGCUUUGGGUGCGAGAGGUCCCGGG
UUCAAAUCCCGGACGAGCCCCGCCUUUU HEK3 +1 FLAG insertion pegRNA sequence:
[SEQ ID NO: 3916]
space, scaffold template and PBSr-
GGCCCAGACUGAGCACGUGAGUUUUAGAGCUAGAAAUAGCAAGUUAAAAU
AAGGCUAGUCCGUUAUCAACUUGAAAAAGUGGCACCGAGUCGGUGCUGGA
GGAAGCAGGGCUUCCUUUCCUCUGCCAUCACUUAUCGUCGUCAUCCUUGU
AAUCCGUGCUCAGUCUG-UGG P1 ext 5 linker 8-UCUCUCUCGG
CGGGGCUCGUUGGUCUAGGGGUAUGAUUCUCGCUUUGGGUGCGAGAGGUC
CCGGGUUCAAAUCCCGGACGAGCCCCGCCUUUU HEK3 +1 FLAG insertion pegRNA sequence:
[SEQ ID NO: 3917]
space, scaffold template and PBSr-
GGCCCAGACUGAGCACGUGAGUUUUAGAGCUAGAAAUAGCAAGUUAAAA
UAAGGCUAGUCCGUUAUCAACUUGAAAAAGUGGCACCGAGUCGGUGCUGG
AGGAAGCAGGGCUUCCUUUCCUCUGCCAUCACUUAUCGUCGUCAUCCUUG
UAAUCCGUGCUCAGUCUG-UGG P1 ext 8 linker 8-
UCUCUCUCCGAGGCGGGGCUCGUUGGUCUAGGGGUAUGAUUCUCGCUUUG
GGUGCGAGAGGUCCCGGGUUCAAAUCCCGGACGAGCCCCGCCUCGUUUU HEK3 +1 FLAG insertion pegRNA sequence:
[SEQ ID NO: 3918]
space, scaffold template and PBSr-
GGCCCAGACUGAGCACGUGAGUUUUAGAGCUAGAAAUAGCAAGUUAAAAU
AAGGCUAGUCCGUUAUCAACUUGAAAAAGUGGCACCGAGUCGGUGCUGGA
GGAAGCAGGGCUUCCUUUCCUCUGCCAUCACUUAUCGUCGUCAUCCUUGU
AAUCCGUGCUCAGUCUG-UGG P1 ext 11 linker 8-
UCUCUCUCGCUCGAGGCGGGGCUCGUUGGUCUAGGGGUAUGAUUCUCGCU
UUGGGUGCGAGAGGUCCCGGGUUCAAAUCCCGGACGAGCCCCGCCUCGAG
UCUUU HEK3 +1 FLAG insertion pegRNA sequence:
[SEQ ID NO: 3919]
space, scaffold template and PBSr-
GGCCCAGACUGAGCACGUGAGUUUUAGAGCUAGAAAUAGCAAGUUAAAAU
AAGGCUAGUCCGUUAUCAACUUGAAAAAGUGGCACCGAGUCGGUGCUGGA
GGAAGCAGGGCUUCCUUUCCUCUGCCAUCACUUAUCGUCGUCAUCCUUGU
AAUCCGUGCUCAGUCUG-UGG P1 ext 14 linker 8-
UCUCUCUCGGUGCUCGAGGCGGGGCUCGUUGGUCUAGGGGUAUGAUUCUC
GCUUUGGGUGCGAGAGGUCCCGGGUUCAAAUCCCGGACGAGCCCCGCCUC
GAGCACCUUUU RNF2 +1 C to A pegRNA sequence:
[SEQ ID NO: 3920]
space, scaffold template and PBSr-
GUCAUCUUAGUCAUUACCUGGUUUUAGAGCUAGAAAUAGCAAGUUAAAAU
AAGGCUAGUCCGUUAUCAACUUGAAAAAGUGGCACCGAGUCGGUGCGAAC
ACCUCAUGUAAUGACUAAGAUG-tRNA-Pro{CGG}-5-
UCUGGCGGGGCUCGUUGGUCUAGGGGUAUGAUUCUCGCUUCGGGUGCGAG
AGGUCCCGGGUUCAAAUCCCGGACGAGCCCCGCC RNF2 +1 C to A pegRNA sequence:
[SEQ ID NO: 3921]
space, scaffold template and PBSr-
GUCAUCUUAGUCAUUACCUGGUUUUAGAGCUAGAAAUAGCAAGUUAAAAU -continued

AAGGCUAGUCCGUUAUCAACUUGAAAAAGUGGCACCGAGUCGGUGCGAAC

ACCUCAUGUAAUGACUAAGAUG-tRNA-Pro{CGG}-8-

UCUCGAGGCGGGGCUCGUUGGUCUAGGGGUAUGAUUCUCGCUUCGGUGC

GAGAGGUCCCGGGUUCAAAUCCCGGACGAGCCCCGCCUCGUUUU

RNF2 +1 C to A pegRNA sequence:
[SEQ ID NO: 3922]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{CGG}-11-

UCUGCUCGAGGCGGGGCUCGUUGGUCUAGGGGUAUGAUUCUCGCUUCGG

UGCGAGAGGUCCCGGGUUCAAAUCCCGGACGAGCCCCGCCUCGAGCUUUU

RNF2 +1 C to A pegRNA sequence:
[SEQ ID NO: 3923]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{Lys}-5-

UCUGGCGGGCCCGGAUAGCUCAGUCGGUAGAGCAUCAGACUUUUAAUCUG

AGGGUCCAGGGUUCAAGUCCCUGUUCGGGCCCGCCUUUU

RNF2 +1 C to A pegRNA sequence:
[SEQ ID NO: 3924]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{Lys}-8-

UCUCGAGGCGGGCCCGGAUAGCUCAGUCGGUAGAGCAUCAGACUUUUAAU

CUGAGGGUCCAGGGUUCAAGUCCCUGUUCGGGCCCGCCUCGUUUU

RNF2 +1 C to A pegRNA sequence:
[SEQ ID NO: 3925]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{UGG}-8-

UCUCGAGGCGGGCUCGUUGGUCUAGGGGUAUGAUUCUCGCUUUGGGUGC

GAGAGGUCCCGGGUUCAAAUCCCGGACGAGCCCCGCCUCGUUUU

RNF2 +1 C to A pegRNA sequence:
[SEQ ID NO: 3926]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{UGG}-11-

UCUGCUCGAGGCGGGGCUCGUUGGUCUAGGGGUAUGAUUCUCGCUUUGG

UGCGAGAGGUCCCGGGUUCAAAUCCCGGACGAGCCCCGCCUCGAGCUUUU

RNF2 +1 C to A pegRNA sequence:
[SEQ ID NO: 3927]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{UGG}-8-longer linker-UCUCUCUCCGAGGCGGGGCUCGUUGGUCUAGGGGUAUGAUUCU

CGCUUUGGGUGCGAGAGGUCCCGGGUUCAAAUCCCGGACGAGCCCCGCCU

CGUUUU

RNF2 +1 C to A pegRNA sequence:
[SEQ ID NO: 3928]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{UGG}-11-longer linker-UCUCUCUCGCUCGAGGCGGGGCUCGUUGGUCUAGGGGUAUGAU

UCUCGCUUUGGGUGCGAGAGGUCCCGGGUUCAAAUCCCGGACGAGCCCCG

CCUCGAGCUUUU

RNF2 +1 C to A pegRNA sequence:
[SEQ ID NO: 3929]
space, scaffold template and PBSr-

GUCAUCUUAGUCAUUACCUGGUUUUAGAGCUAGAAAUAGCAAGUUAAAAU

AAGGCUAGUCCGUUAUCAACUUGAAAAAGUGGCACCGAGUCGGUGCGAAC

ACCUCAUGUAAUGACUAAGAUG-tRNA-Pro{UGG}-14-longer linker-UCUCUCUCGGUGCUCGAGGCGGGGCUCGUUGGUCUAGGGGUAU

GAUUCUCGCUUUGGGUGCGAGAGGUCCCGGGUUCAAAUCCCGGACGAGCC

CCGCCUCGAGCACCUUUU

Example 23. Use of Prime Editing to Correct CDKL5 and Sickle Cell Anemia

Use of PE to Design Mouse Model of CDKL5 with 1412delA Mutation

CDKL5 Deficiency Disorder (CDD) is a neurodegenerative disease most often caused by spontaneous mutations in the cyclin-dependent kinase-like 5 gene. Symptoms manifest in early childhood and include seizures, irregular sleeping patterns, gastrointestinal stress, and developmental delay. Some mutations which cause CDD, including 1412delA, cannot be corrected with base editing. However, prime editing has the potential to precisely correct all base-to-base changes, deletions, and insertions. With focus on the 1412delA mutation, this Example designed and tested pegRNAs capable of inserting the mutation in hopes to establish a mouse neuronal cell line (N2A) harboring the mutation. This will allow for extensive screening potentially therapeutic pegRNAs that correct the mutation. The ultimate goal is to be able to move into a CDD mouse model with the 1412delA mutation to assess therapeutic effect. No current mouse models of CDD have a humanized allele, however optimization of pegRNAs is underway in HEK293T cells as well. FIGS. 87 and 88 are the results from a pilot screen in N2A cells where the pegRNA installs 1412Adel, with details about the primer binding site (PBS) length and reverse transcriptase (RT) template length. (Shown with and without indels)

Use of PE to Treat Sickle Cell Anemia (SCA)

Sickle cell anemia (SCA) is a recessive blood disorder caused by a glutamate-to-valine mutation at position 6 in the β-globin gene. The result is sickled red blood cells that are poor oxygen transporters and prone to aggregation. Symptoms of aggregation can be life-threatening. Previously, the D. Liu lab was able to show both the installation and correction of the SCA locus in HEK293T cells using prime editing via DNA plasmid transfection. Since hematopoietic stem cells (HSCs) are difficult to edit via DNA plasmid transfection, this Example tested the PE3 system in HSCs with protein and mRNA nucleofection. FIG. 89 are the results of editing at a proxy locus in the β-globin gene and at HEK3 in healthy HSCs, varying the concentration of editor to pegRNA and nicking gRNA.

mRNA Nucleofection Protocol:

The protocol was improved by adjusting the ratio of editor to guides ([editor] to [guide] ratio or editor:guide ratio)

The nicking guide protospacer sequence was: CCTTGA-TACCAACCTGCCCA (SEQ ID NO: 3991)

The pegRNA sequence was:

(SEQ ID NO: 3992)
CATGGTGCACCTGACTCCTGGTTTTAGAGCTAGAAATAGCAAGTTAAAA

TAAGGCTAGTCCGTTATCAACTTGAAAAAGTGGCACCGAGTCGGTGCAG

ACTTCTCTTCAGGAGTCAGGTGCACTTT

1. Thaw CD34+ cells and pre-stimulate in X-Vivo15 media with cytokines (SCF, Flt3 and TPO) for 24 hrs. Seeding density 1 million cells/mL.

2. Next day (post 24 hrs), aspirate CD34+ cells (1×105) and wash once with PBS (centrifugation performed at 300 g for 10 mins in RT) and resuspend in P3 solution (Lonza) (20 ul per condition).

3. In hood, combine 2 ug of SpPE2 mRNA, 1 ug combined of pegRNA and sgRNA in a sterile PCR strip on ice. Adjust the volume to 20 ul (cells in P3 solution+mRNA &gRNA mix).

4. Pipette up cell suspension into 20 uL Lonza4D 16 well strip and electroporate with program DS130.

5. Wait for 10 to 15 mins post electroporation and add 80 uL of X-Vivo10+cytokine media to cell suspension and transfer to pre-warmed X-Vivo10 with cytokine media.

6. Harvest cells 72 hours after electroporation and check the cell recovery and do genotyping in bulk population and sorted CD34+ and CD34+90+ populations as well.

```
Wildtype CDKL5 protein (Accession No.
NP_001032420) (isoform 1 - human)
                                    (SEQ ID NO: 3993)
MKIPNIGNVM NKFEILGVVG EGAYGVVLKC RHKETHEIVA

IKKFKDSEEN EEVKETTLRE LKMLRTLKQE NIVELKEAFR

RRGKLYLVFE YVEKNMLELL EEMPNGVPPE KVKSYIYQLI

KAIHWCHKND IVHRDIKPEN LLISHNDVLK LCDFGFARNL

SEGNNANYTE YVATRWYRSP ELLLGAPYGK SVDMWSVGCI

LGELSDGQPL FPGESEIDQL FTIQKVLGPL PSEQMKLFYS

NPRFHGLRFP AVNHPQSLER RYLGILNSVL LDLMKNLLKL

DPADRYLTEQ CLNHPTFQTQ RLLDRSPSRS AKRKPYHVES

STLSNRNQAG KSTALQSHHR SNSKDIQNLS VGLPRADEGL

PANESFLNGN LAGASLSPLH TKTYQASSQP GSTSKDLTNN

NIPHLLSPKE AKSKTEFDFN IDPKPSEGPG TKYLKSNSRS

QQNRHSFMES SQSKAGTLQP NEKQSRHSYI DTIPQSSRSP

SYRTKAKSHG ALSDSKSVSN LSEARAQIAE PSTSRYFPSS

CLDLNSPTSP TPTRHSDTRT LLSPSGRNNR NEGTLDSRRT

TTRHSKTMEE LKLPEHMDSS HSHSLSAPHE SFSYGLGYTS

PFSSQQRPHR HSMYVTRDKV RAKGLDGSLS IGQGMAARAN

SLQLLSPQPG EQLPPEMTVA RSSVKETSRE GTSSFHTRQK

SEGGVYHDPH SDDGTAPKEN RHLYNDPVPR RVGSFYRVPS

PRPDNSFHEN NVSTRVSSLP SESSSGTNHS KRQPAFDPWK

SPENISHSEQ LKEKEKQGFF RSMKKKKKKS QTVPNSDSPD

LLTLQKSIHS ASTPSSRPKE WRPEKISDLQ TQSQPLKSLR

KLLHLSSASN HPASSDPRFQ PLTAQQTKNS FSEIRIHPLS

QASGGSSNIR QEPAPKGRPA LQLPDGGCDG RRQRHHSGPQ

DRRFMLRTTE QQGEYFCCGD PKKPHTPCVP NRALHRPISS

PAPYPVLQVR GTSMCPTLQV RGTDAFSCPT QQSGFSFFVR

HVMREALIHR AQVNQAALLT YHENAALTGK

Wildtype CDKL5 protein (Accession No.
NP_001310218) (isoform 2 - human)
                                    (SEQ ID NO: 3994)
MKIPNIGNVM NKFEILGVVG EGAYGVVLKC RHKETHEIVA

IKKFKDSEEN EEVKETTLRE LKMLRTLKQE NIVELKEAFR

RRGKLYLVFE YVEKNMLELL EEMPNGVPPE KVKSYIYQLI

KAIHWCHKND IVHRDIKPEN LLISHNDVLK LCDFGFARNL

SEGNNANYTE YVATRWYRSP ELLLGAPYGK SVDMWSVGCI

LGELSDGQPL FPGESEIDQL FTIQKVLGPL PSEQMKLFYS

NPRFHGLRFP AVNHPQSLER RYLGILNSVL LDLMKNLLKL

DPADRYLTEQ CLNHPTFQTQ RLLDRSPSRS AKRKPYHVES

STLSNRNQAG KSTALQSHHR SNSKDIQNLS VGLPRADEGL

PANESFLNGN LAGASLSPLH TKTYQASSQP GSTSKDLTNN

NIPHLLSPKE AKSKTEFDFN IDPKPSEGPG TKYLKSNSRS

QQNRHSFMES SQSKAGTLQP NEKQSRHSYI DTIPQSSRSP

SYRTKAKSHG ALSDSKSVSN LSEARAQIAE PSTSRYFPSS

CLDLNSPTSP TPTRHSDTRT LLSPSGRNNR NEGTLDSRRT

TTRHSKTMEE LKLPEHMDSS HSHSLSAPHE SFSYGLGYTS

PFSSQQRPHR HSMYVTRDKV RAKGLDGSLS IGQGMAARAN

SLQLLSPQPG EQLPPEMTVARSSVKETSRE GTSSFHTRQK

SEGGVYHDPH SDDGTAPKEN RHLYNDPVPR RVGSFYRVPS

PRPDNSFHEN NVSTRVSSLP SESSSGTNHS KRQPAFDPWK

SPENISHSEQ LKEKEKQGFF RSMKKKKKKS QTVPNSDSPD
```

```
                              -continued
LLTLQKSIHS ASTPSSRPKE WRPEKISDLQ TQSQPLKSLR

KLLHLSSASN HPASSDPRFQ PLTAQQTKNS FSEIRIHPLS

QASGGSSNIR QEPAPKGRPA LQLPGQMDPG WHVSSVTRSA

TEGPSYSEQL GAKSGPNGHP YNRTNRSRMP NLNDLKETAL
```

Example 24. Use of Prime Editing to Target Pathogenic AOL1 Alleles as Treatment for Non-Diabetic Chronic Kidney Disease This Example designed PEgRNAs that are capable of targeting pathogenic APOL1 alleles for use with prime editing to treat or reduce the likelihood of developing a renal disease.

End-stage kidney failure (ESKD) is a growing problem that now affects over half a million individuals in the United States. The cost of caring for patients with ESKD is currently over 40 billion dollars per year. In the U.S., the likelihood that subjects of African descent will develop ESKD is 4 to 5 times higher than for Americans without African ancestry. These facts are reflected in the disparity between the 12-13% of the U.S. population with African descent and the 40% of U.S. dialysis patients who are African-American. The epidemic of renal disease risk factors, such as obesity and metabolic syndrome, suggests that the magnitude of this problem will only increase.

There are no specific therapies for the vast majority of progressive kidney diseases. Some types of chronic renal disease progression can be slowed by blood pressure control with specific agents, but nephrologists cannot accurately predict which patients will respond. Moreover, while successful treatment typically slows progression, it neither prevents disease nor halts disease progression.

Recently it was determined that that specific genetic variants that alter the protein sequence of APOlipoprotein-L1 (APOL1) are associated with progressive kidney disease. Surprisingly, APOL1 kidney disease variants have a major impact on multiple different types of kidney disease including hypertension-associated end-stage renal disease (H-ESRD), focal segmental glomerulosclerosis (FSGS), and HIV-associated nephropathy (HIVAN). Individuals with these variant APOL1 alleles have a 7-30 fold increased risk for kidney disease. Based on the high frequency of these APOL1 risk alleles, more than 3.5 million African Americans likely have the high risk APOL1 genotype. African Americans without the high risk genotype have little excess risk compared with Americans of European ancestry.

Despite evidence that variants in the APOL1 gene cause renal disease, very little is known about the biology of its product, APOL1, or its role in the kidney. APOL1 has a defined role in resistance to trypanosomes, and the G1 and G2 variants appear to have become common in Africa because they confer protection against the forms of trypanosomes that cause African Sleeping Sickness.

There still exists a need for therapies for kidney diseases in patients with one or more APOL1 risk alleles, which cause great morbidity and mortality with high economic impact in this and other subject populations.

This Example provides three exemplary PEgRNA design options based on a specific exemplary target sequence that may be used with prime editing to correct APOL1 defective alleles.

PEgRNA 1

Designing PEgRNAs for APOL1 allele rs73885319 (p.S342G). This represents a G→A correction in affected individuals. The target sequence is 5-GGAGTCAAGCT-CACGGATGTGGCCCCTGTA(G-to-A)GCTTCTTTCTTGTG CTGGATGTAGTCTACCT-3.(SEQ ID NO: 3995)

The protospacer (bolded above) is AAGCTCACG-GATGTGGCCCC (SEQ ID NO: 3996). The selected PE comprises a SaCas9(D10A).

The primer binding sites can be:

| | |
|---|---|
| GTGGCCCC | (SEQ ID NO: 3997) |
| TGTGGCCCC | (SEQ ID NO: 3998) |
| ATGTGGCCCC | (SEQ ID NO: 3999) |
| GATGTGGCCCC | (SEQ ID NO: 4000) |
| GGATGTGGCCCC | (SEQ ID NO: 4001) |
| CGGATGTGGCCCC | (SEQ ID NO: 4002) |
| ACGGATGTGGCCCC | (SEQ ID NO: 4003) |
| CACGGATGTGGCCCC | (SEQ ID NO: 4004) |
| TCACGGATGTGGCCCC | (SEQ ID NO: 4005) |
| CTCACGGATGTGGCCCC | (SEQ ID NO: 4006) |

The RT templates can be:

| | |
|---|---|
| AAGAAGCTTACA | (SEQ ID NO: 4007) |
| AAAGAAGCTTACA | (SEQ ID NO: 4008) |
| GAAAGAAGCTTACA | (SEQ ID NO: 4009) |
| AGAAAGAAGCTTACA | (SEQ ID NO: 4010) |
| AAGAAAGAAGCTTACA | (SEQ ID NO: 4011) |
| CAAGAAAGAAGCTTACA | (SEQ ID NO: 4012) |
| ACAAGAAAGAAGCTTACA | (SEQ ID NO: 4013) |
| CACAAGAAAGAAGCTTACA | (SEQ ID NO: 4014) |
| GCACAAGAAAGAAGCTTACA | (SEQ ID NO: 4015) |
| AGCACAAGAAAGAAGCTTACA | (SEQ ID NO: 4016) |
| CAGCACAAGAAAGAAGCTTACA | (SEQ ID NO: 4017) |
| CCAGCACAAGAAAGAAGCTTACA | (SEQ ID NO: 4018) |
| TCCAGCACAAGAAAGAAGCTTACA | (SEQ ID NO: 4019) |
| ATCCAGCACAAGAAAGAAGCTTACA | (SEQ ID NO: 4020) |

The nicking template can be GCTTTGATTCGTA-CACGAGG (SEQ ID NO: 4021).

PEgRNA 2

Designing PEgRNAs for APOL1 allele rs60910145. This represents a G→T correction in affected individuals.

The protospacer is GCTGGAGGAGAAGCTAAACA. (SEQ ID NO: 4022) The selected PE comprises SpCas9 (D10A)-NG.

The primer binding sites can be:

| | |
|---|---|
| GAAGCTAA | (SEQ NO ID: 4023) |
| AGAAGCTAA | (SEQ NO ID: 4024) |

| | |
|---|---|
| GAGAAGCTAA | (SEQ NO ID: 4025) |
| GGAGAAGCTAA | (SEQ NO ID: 4026) |
| AGGAGAAGCTAA | (SEQ NO ID: 4027) |
| GAGGAGAAGCTAA | (SEQ NO ID: 4028) |
| GGAGGAGAAGCTAA | (SEQ NO ID: 4029) |
| TGGAGGAGAAGCTAA | (SEQ NO ID: 4030) |
| CTGGAGGAGAAGCTAA | (SEQ NO ID: 4031) |
| GCTGGAGGAGAAGCTAA | (SEQ NO ID: 4032) |

The RT template can be (cannot end in C):

| | |
|---|---|
| AGAATGT | (SEQ ID NO: 4033) |
| GAGAATGT | (SEQ ID NO: 4034) |
| TGAGAATGT | (SEQ ID NO: 4035) |
| TTGAGAATGT | (SEQ ID NO: 4036) |
| GTTGAGAATGT | (SEQ ID NO: 4037) |
| TGTTGAGAATGT | (SEQ ID NO: 4038) |
| TTGTTGAGAATGT | (SEQ ID NO: 4039) |
| ATTGTTGAGAATGT | (SEQ ID NO: 4040) |
| TATTGTTGAGAATGT | (SEQ ID NO: 4041) |
| TTATTGTTGAGAATGT | (SEQ ID NO: 4042) |
| ATTATTGTTGAGAATGT | (SEQ ID NO: 4043) |
| AATTATTGTTGAGAATGT | (SEQ ID NO: 4044) |
| TAATTATTGTTGAGAATGT | (SEQ ID NO: 4045) |
| ATAATTATTGTTGAGAATGT | (SEQ ID NO: 4046) |

The nicking templates can be:

| | |
|---|---|
| CCTGTGGTCACAGTTCTTGG | (SEQ ID NO: 4047) |
| CCACAGGGCAGGGCAGCCAC | (SEQ ID NO: 4048). |

PEgRNA 3

Designing PEgRNAs for APOL1 allele rs71785313. This represents an insert, as follows: ATTCTCAACAA[insert: TAATTA]TAAGATTC (SEQ ID NO: 4049).

The protospacer can be: TCTCAACAATAAGATTCTGC (SEQ ID NO: 4050)

The PE comprises SaKKH-PE2.

The primer binding site can be:

| | |
|---|---|
| TTCTCAAC | (SEQ ID NO: 4051) |
| ATTCTCAAC | (SEQ ID NO: 4052) |
| CATTCTCAAC | (SEQ ID NO: 4053) |
| ACATTCTCAAC | (SEQ ID NO: 4054) |
| AACATTCTCAAC | (SEQ ID NO: 4055) |
| AAACATTCTCAAC | (SEQ ID NO: 4056) |
| TAAACATTCTCAAC | (SEQ ID NO: 4057) |
| CTAAACATTCTCAAC | (SEQ ID NO: 4058) |
| GCTAAACATTCTCAAC | (SEQ ID NO: 4059) |
| AGCTAAACATTCTCAAC | (SEQ ID NO: 4060) |

The RT template can be:

| | |
|---|---|
| AATCTTATAATTATT | (SEQ ID NO: 4061) |
| GAATCTTATAATTATT | (SEQ ID NO: 4062) |
| AGAATCTTATAATTATT | (SEQ ID NO: 4063) |
| CAGAATCTTATAATTATT | (SEQ ID NO: 4064) |
| GCAGAATCTTATAATTATT | (SEQ ID NO: 4065) |
| TGCAGAATCTTATAATTATT | (SEQ ID NO: 4066) |
| CTGCAGAATCTTATAATTATT | (SEQ ID NO: 4067) |
| CCTGCAGAATCTTATAATTATT | (SEQ ID NO: 4068) |
| GCCTGCAGAATCTTATAATTATT | (SEQ ID NO: 4069) |
| CGCCTGCAGAATCTTATAATTATT | (SEQ ID NO: 4070) |
| CCGCCTGCAGAATCTTATAATTATT | (SEQ ID NO: 4071) |
| TCCGCCTGCAGAATCTTATAATTATT | (SEQ ID NO: 4072) |
| GTCCGCCTGCAGAATCTTATAATTATT | (SEQ ID NO: 4073) |
| GGTCCGCCTGCAGAATCTTATAATTATT | (SEQ ID NO: 4074) |

The nicking templates can be:

| | |
|---|---|
| CCTGTGGTCACAGTTCTTGG | (SEQ ID NO: 4047) |
| CCACAGGGCAGGGCAGCCAC | (SEQ ID NO: 4048). |

Other References Mentioned Throughout this Disclosure

The following references are each incorporated herein by reference in their entireties.

1. Jinek, M. et al. A Programmable Dual-RNA-Guided DNA Endonuclease in Adaptive Bacterial Immunity. *Science* 337, 816-821 (2012).
2. Cong, L. et al. Multiplex Genome Engineering Using CRISPR/Cas Systems. *Science* 339, 819-823 (2013).
3. Komor, A. C., Badran, A. H. & Liu, D. R. CRISPR-Based Technologies for the Manipulation of Eukaryotic Genomes. *Cell* 168, 20-36 (2017).
4. Komor, A. C., Kim, Y. B., Packer, M. S., Zuris, J. A. & Liu, D. R. Programmable editing of a target base in genomic DNA without double-stranded DNA cleavage. *Nature* 533, 420-424 (2016).
5. Nishida, K. et al. Targeted nucleotide editing using hybrid prokaryotic and vertebrate adaptive immune systems. *Science* 353, aaf8729 (2016).
6. Gaudelli, N. M. et al. Programmable base editing of A.T to G.C in genomic DNA without DNA cleavage. *Nature* 551, 464-471 (2017).
7. ClinVar, July 2019.
8. Dunbar, C. E. et al. Gene therapy comes of age. *Science* 359, eaan4672 (2018).
9. Cox, D. B. T., Platt, R. J. & Zhang, F. Therapeutic genome editing: prospects and challenges. *Nat. Med.* 21, 121-131 (2015).
10. Adli, M. The CRISPR tool kit for genome editing and beyond. *Nat. Commun.* 9, 1911 (2018).

11. Kleinstiver, B. P. et al. Engineered CRISPR-Cas9 nucleases with altered PAM specificities. *Nature* 523, 481-485 (2015).
12. Kleinstiver, B. P. et al. High-fidelity CRISPR-Cas9 nucleases with no detectable genome-wide off-target effects. *Nature* 529, 490-495 (2016).
13. Hu, J. H. et al. Evolved Cas9 variants with broad PAM compatibility and high DNA specificity. *Nature* 556, 57-63 (2018).
14. Nishimasu, H. et al. Engineered CRISPR-Cas9 nuclease with expanded targeting space. *Science* 361, 1259-1262 (2018).
15. Jasin, M. & Rothstein, R. Repair of strand breaks by homologous recombination. *Cold Spring Harb. Perspect. Biol.* 5, a012740 (2013).
16. Paquet, D. et al. Efficient introduction of specific homozygous and heterozygous mutations using CRISPR/Cas9. *Nature* 533, 125-129 (2016).
17. Kosicki, M., Tomberg, K. & Bradley, A. Repair of double-strand breaks induced by CRISPR-Cas9 leads to large deletions and complex rearrangements. *Nat. Biotechnol.* 36, 765-771 (2018).
18. Haapaniemi, E., Botla, S., Persson, J., Schmierer, B. & Taipale, J. CRISPR-Cas9 genome editing induces a p53-mediated DNA damage response. *Nat. Med.* 24, 927-930 (2018).
19. Ihry, R. J. et al. p53 inhibits CRISPR-Cas9 engineering in human pluripotent stem cells. *Nat. Med.* 24, 939-946 (2018).
20. Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. *Nat. Biotechnol.* 34, 339-344 (2016).
21. Srivastava, M. et al. An Inhibitor of Nonhomologous End-Joining Abrogates Double-Strand Break Repair and Impedes Cancer Progression. *Cell* 151, 1474-1487 (2012).
22. Chu, V. T. et al. Increasing the efficiency of homology-directed repair for CRISPR-Cas9-induced precise gene editing in mammalian cells. *Nat. Biotechnol.* 33, 543-548 (2015).
23. Maruyama, T. et al. Increasing the efficiency of precise genome editing with CRISPR-Cas9 by inhibition of nonhomologous end joining. *Nat. Biotechnol.* 33, 538-542 (2015).
24. Kim, Y. B. et al. Increasing the genome-targeting scope and precision of base editing with engineered Cas9-cytidine deaminase fusions. *Nat. Biotechnol.* 35, 371-376 (2017).
25. Li, X. et al. Base editing with a Cpf1-cytidine deaminase fusion. *Nat. Biotechnol.* 36, 324-327 (2018).
26. Gehrke, J. M. et al. An APOBEC3A-Cas9 base editor with minimized bystander and off-target activities. *Nat. Biotechnol.* (2018). doi:10.1038/nbt.4199
27. Rees, H. A. & Liu, D. R. Base editing: precision chemistry on the genome and transcriptome of living cells. *Nat. Rev. Genet.* 1 (2018). doi:10.1038/s41576-018-0059-1.
28. Ostertag, E. M. & Kazazian Jr, H. H. Biology of Mammalian L1 Retrotransposons. *Annu. Rev. Genet.* 35, 501-538 (2001).
29. Zimmerly, S., Guo, H., Perlman, P. S. & Lambowltz, A. M. Group II intron mobility occurs by target DNA-primed reverse transcription. *Cell* 82, 545-554 (1995).
30. Luan, D. D., Korman, M. H., Jakubczak, J. L. & Eickbush, T. H. Reverse transcription of R2Bm RNA is primed by a nick at the chromosomal target site: a mechanism for non-LTR retrotransposition. *Cell* 72, 595-605 (1993).
31. Feng, Q., Moran, J. V., Kazazian, H. H. & Boeke, J. D. Human L1 retrotransposon encodes a conserved endonuclease required for retrotransposition. *Cell* 87, 905-916 (1996).
32. Jinek, M. et al. Structures of Cas9 Endonucleases Reveal RNA-Mediated Conformational Activation. *Science* 343, 1247997 (2014).
33. Jiang, F. et al. Structures of a CRISPR-Cas9 R-loop complex primed for DNA cleavage. *Science* aad8282 (2016). doi:10.1126/science.aad8282
34. Qi, L. S. et al. Repurposing CRISPR as an RNA-Guided Platform for Sequence-Specific Control of Gene Expression. *Cell* 152, 1173-1183 (2013).
35. Tang, W., Hu, J. H. & Liu, D. R. Aptazyme-embedded guide RNAs enable ligand-responsive genome editing and transcriptional activation. *Nat. Commun.* 8, 15939 (2017).
36. Shechner, D. M., Hacisuleyman, E., Younger, S. T. & Rinn, J. L. Multiplexable, locus-specific targeting of long RNAs with CRISPR-Display. *Nat. Methods* 12, 664-670 (2015).
37. Anders, C. & Jinek, M. Chapter One—In vitro Enzymology of Cas9. in *Methods in Enzymology* (eds. Doudna, J. A. & Sontheimer, E. J.) 546, 1-20 (Academic Press, 2014).
38. Briner, A. E. et al. Guide RNA Functional Modules Direct Cas9 Activity and Orthogonality. *Mol. Cell* 56, 333-339 (2014).
39. Nowak, C. M., Lawson, S., Zerez, M. & Bleris, L. Guide RNA engineering for versatile Cas9 functionality. *Nucleic Acids Res.* 44, 9555-9564 (2016).
40. Sternberg, S. H., Redding, S., Jinek, M., Greene, E. C. & Doudna, J. A. DNA interrogation by the CRISPR RNA-guided endonuclease Cas9. *Nature* 507, 62-67 (2014).
41. Mohr, S. et al. Thermostable group II intron reverse transcriptase fusion proteins and their use in cDNA synthesis and next-generation RNA sequencing. *RNA* 19, 958-970 (2013).
42. Stamos, J. L., Lentzsch, A. M. & Lambowitz, A. M. Structure of a Thermostable Group II Intron Reverse Transcriptase with Template-Primer and Its Functional and Evolutionary Implications. *Mol. Cell* 68, 926-939.e4 (2017).
43. Zhao, C. & Pyle, A. M. Crystal structures of a group II intron maturase reveal a missing link in spliceosome evolution. *Nat. Struct. Mol. Biol.* 23, 558-565 (2016).
44. Zhao, C., Liu, F. & Pyle, A. M. An ultraprocessive, accurate reverse transcriptase encoded by a metazoan group II intron. *RNA* 24, 183-195 (2018).
45. Ran, F. A. et al. Genome engineering using the CRISPR-Cas9 system. *Nat. Protoc.* 8, 2281-2308 (2013).
46. Liu, Y., Kao, H.-I. & Bambara, R. A. Flap endonuclease 1: a central component of DNA metabolism. *Annu. Rev. Biochem.* 73, 589-615 (2004).
47. Krokan, H. E. & Bjørås, M. Base Excision Repair. *Cold Spring Harb. Perspect. Biol.* 5, (2013).
48. Kelman, Z. PCNA: structure, functions and interactions. *Oncogene* 14, 629-640 (1997).
49. Choe, K. N. & Moldovan, G.-L. Forging Ahead through Darkness: PCNA, Still the Principal Conductor at the Replication Fork. *Mol. Cell* 65, 380-392 (2017).
50. Li, X., Li, J., Harrington, J., Lieber, M. R. & Burgers, P. M. Lagging strand DNA synthesis at the eukaryotic 50. replication fork involves binding and stimulation of FEN-1 by proliferating cell nuclear antigen. *J. Biol. Chem.* 270, 22109-22112 (1995).
51. Tom, S., Henricksen, L. A. & Bambara, R. A. Mechanism whereby proliferating cell nuclear antigen stimulates flap endonuclease 1. *J. Biol. Chem.* 275, 10498-10505 (2000).
52. Tanenbaum, M. E., Gilbert, L. A., Qi, L. S., Weissman, J. S. & Vale, R. D. A protein-tagging system for signal amplification in gene expression and fluorescence imaging. *Cell* 159, 635-646 (2014).
53. Bertrand, E. et al. Localization of ASH1 mRNA particles in living yeast. *Mol. Cell* 2, 437-445 (1998).
54. Dahlman, J. E. et al. Orthogonal gene knockout and activation with a catalytically active Cas9 nuclease. *Nat. Biotechnol.* 33, 1159-1161 (2015).
55. Tsai, S. Q. et al. GUIDE-seq enables genome-wide profiling of off-target cleavage by CRISPR-Cas nucleases. *Nat. Biotechnol.* 33, 187-197 (2015).
56. Tsai, S. Q. et al. CIRCLE-seq: a highly sensitive in vitro screen for genome-wide CRISPR-Cas9 nuclease off-targets. *Nat. Methods* 14, 607-614 (2017).
57. Schek N, Cooke C, Alwine J C. Molecular and Cellular Biology. (1992).
58. Gil A, Proudfoot N J. Cell. (1987).
59. Zhao, B. S., Roundtree, I. A., He, C. Nat Rev Mol Cell Biol. (2017).
60. Rubio, M. A. T., Hopper, A. K. Wiley Interdiscip Rev RNA (2011).
61. Shechner, D. M., Hacisuleyman E., Younger, S. T., Rinn, J. L. Nat Methods. (2015).
62. Paige, J. S., Wu, K. Y., Jaffrey, S. R. Science (2011).
63. Ray D., . . . Hughes T R. Nature (2013).
64. Chadalavada, D. M., Cerrone-Szakal, A. L., Bevilacqua, P. C. RNA (2007).
65. Forster A C, Symons R H. Cell. (1987).
66. Weinberg Z, Kim P B, Chen T H, Li S, Harris K A, Lünse C E, Breaker R R. Nat. Chem. Biol. (2015).
67. Feldstein P A, Buzayan J M, Bruening G. Gene (1989).
68. Saville B J, Collins R A. Cell. (1990).
69. Winkler W C, Nahvi A, Roth A, Collins J A, Breaker R R. Nature (2004).
70. Roth A, Weinberg Z, Chen A G, Kim P G, Ames T D, Breaker R R. Nat Chem Biol. (2013).
71. Choudhury R, Tsai Y S, Dominguez D, Wang Y, Wang Z. Nat Commun. (2012).
72. MacRae I J, Doudna J A. Curr Opin Struct Biol. (2007).
73. Bernstein E, Caudy A A, Hammond S M, Hannon G J Nature (2001).
74. Filippov V, Solovyev V, Filippova M, Gill S S. Gene (2000).
75. Cadwell R C and Joyce G F. PCR Methods Appl. (1992).
76. McInerney P, Adams P, and Hadi M Z. Mol Biol Int. (2014).
77. Esvelt K M, Carlson J C, and Liu D R. Nature. (2011).
78. Naorem S S, Hin J, Wang S, Lee W R, Heng X, Miller J F, Guo H. Proc Natl Acad Sci USA (2017).
79. Martinez M A, Vartanian J P, Wain-Hobson S. Proc Natl Acad Sci USA (1994).
80. Meyer A J, Ellefson J W, Ellington A D. Curr Protoc Mol Biol. (2014).
81. Wang H H, Isaacs F J, Can P A, Sun Z Z, Xu G, Forest C R, Church G M. Nature. (2009).
82. Nyerges Á et al. Proc Natl Acad Sci USA. (2016).
83. Mascola J R, Haynes B F. Immunol Rev. (2013).
84. X. Wen, K. Wen, D. Cao, G. Li, R. W. Jones, J. Li, S. Szu, Y. Hoshino, L. Yuan, Inclusion of a universal tetanus toxoid CD4(+) T cell epitope P2 significantly enhanced the immunogenicity of recombinant rotavirus ΔVP8* subunit parenteral vaccines. Vaccine 32, 4420-4427 (2014).
85. G. Ada, D. Isaacs, Carbohydrate-protein conjugate vaccines. Clin Microbiol Infect 9, 79-85 (2003).
86. E. Malito, B. Bursulaya, C. Chen, P. L. Surdo, M. Picchianti, E. Balducci, M. Biancucci, A. Brock, F. Berti, M. J. Bottomley, M. Nissum, P. Costantino, R. Rappuoli, G. Spraggon, Structural basis for lack of toxicity of the diphtheria toxin mutant CRM197. Proceedings of the National Academy of Sciences 109, 5229 (2012).
87. J. de Wit, M. E. Emmelot, M. C. M. Poelen, J. Lanfermeijer, W. G. H. Han, C. van Els, P. Kaaijk, The Human CD4(+) T Cell Response against Mumps Virus Targets a Broadly Recognized Nucleoprotein Epitope. J Virol 93, (2019).
88. M. May, C. A. Rieder, R. J. Rowe, Emergent lineages of mumps virus suggest the need for a polyvalent vaccine. Int J Infect Dis 66, 1-4 (2018).
89. M. Ramamurthy, P. Rajendiran, N. Saravanan, S. Sankar, S. Gopalan, B. Nandagopal, Identification of immunogenic B-cell epitope peptides of rubella virus E1 glycoprotein towards development of highly specific immunoassays and/or vaccine. Conference Abstract, (2019).
90. U. S. F. Tambunan, F. R. P. Sipahutar, A. A. Parikesit, D. Kerami, Vaccine Design for H5N1 Based on B- and T-cell Epitope Predictions. Bioinform Biol Insights 10, 27-35 (2016).
91. Asante, E A. et. al. "A naturally occurring variant of the human prion protein completely prevents prion disease". Nature. (2015).
92. Crabtree, G. R. & Schreiber, S. L. Three-part inventions: intracellular signaling and induced proximity. *Trends Biochem. Sci.* 21, 418-22 (1996).
93. Liu, J. et al. Calcineurin Is a Common Target of A and FKBP-FK506 Complexes. *Cell* 66, 807-815 (1991).
94. Keith, C. T. et al. A mammalian protein targeted by G1-arresting rapamycin-receptor complex. *Nature* 369, 756-758 (2003).
95. Spencer, D. M., Wandless, T. J., Schreiber, S. L. S. & Crabtree, G. R. Controlling signal transduction with synthetic ligands. *Science* 262, 1019-24 (1993).
96. Pruschy, M. N. et al. Mechanistic studies of a signaling pathway activated by the organic dimerizer FK1012. *Chem. Biol.* 1, 163-172 (1994).
97. Spencer, D. M. et al. Functional analysis of Fas signaling in vivo using synthetic inducers of dimerization. *Curr. Biol.* 6, 839-847 (1996).
98. Belshaw, P. J., Spencer, D. M., Crabtree, G. R. & Schreiber, S. L. Controlling programmed cell death with a cyclophilin-cyclosporin-based chemical inducer of dimerization. *Chem. Biol.* 3, 731-738 (1996).
99. Yang, J. X., Symes, K., Mercola, M. & Schreiber, S. L. Small-molecule control of insulin and PDGF receptor signaling and the role of membrane attachment. *Curr. Biol.* 8, 11-18 (1998).
100. Belshaw, P. J., Ho, S. N., Crabtree, G. R. & Schreiber, S. L. Controlling protein association and subcellular localization with a synthetic ligand that induces heterodimerization of proteins. *Proc. Natl. Acad. Sci.* 93, 4604-4607 (2002).
101. Stockwell, B. R. & Schreiber, S. L. Probing the role of homomeric and heteromeric receptor interactions in TGF-β signaling using small molecule dimerizers. *Curr. Biol.* 8, 761-773 (2004).

102. Spencer, D. M., Graef, I., Austin, D. J., Schreiber, S. L. & Crabtree, G. R. A general strategy for producing conditional alleles of Src-like tyrosine kinases. *Proc. Natl. Acad. Sci.* 92, 9805-9809 (2006).
103. Holsinger, L. J., Spencer, D. M., Austin, D. J., Schreiber, S. L. & Crabtree, G. R. Signal transduction in T lymphocytes using a conditional allele of Sos. *Proc. Natl. Acad. Sci.* 92, 9810-9814 (2006).
104. Myers, M. G. Insulin Signal Transduction and the IRS Proteins. *Annu. Rev. Pharmacol. Toxicol.* 36, 615-658 (1996).
105. Watowich, S. S. The erythropoietin receptor: Molecular structure and hematopoietic signaling pathways. *J. Investig. Med.* 59, 1067-1072 (2011).
106. Blau, C. A., Peterson, K. R., Drachman, J. G. & Spencer, D. M. A proliferation switch for genetically modified cells. *Proc. Natl. Acad. Sci.* 94, 3076-3081 (2002).
107. Clackson, T. et al. Redesigning an FKBP-ligand interface to generate chemical dimerizers with novel specificity. *Proc. Natl. Acad. Sci.* 95, 10437-10442 (1998).
108. Diver, S. T. & Schreiber, S. L. Single-step synthesis of cell-permeable protein dimerizers that activate signal transduction and gene expression. *J. Am. Chem. Soc.* 119, 5106-5109 (1997).
109. Guo, Z. F., Zhang, R. & Liang, F. Sen. Facile functionalization of FK506 for biological studies by the thiol-ene 'click' reaction. *RSC Adv.* 4, 11400-11403 (2014).
110. Robinson, D. R., Wu, Y.-M. & Lin, S.-F. The protein tyrosine kinase family of the human genome. Oncogene 19, 5548-5557 (2000).
111. Landrum, M. J. et al. ClinVar: public archive of interpretations of clinically relevant variants. Nucleic Acids Res. 44, D862-D868 (2016).
112. Jinek, M. et al. A Programmable Dual-RNA-Guided DNA Endonuclease in Adaptive Bacterial Immunity. *Science* 337, 816-821 (2012).
113. Cong, L. et al. Multiplex Genome Engineering Using CRISPR/Cas Systems. Science 339, 819-823 (2013).
114. Mali, P. et al. RNA-Guided Human Genome Engineering via Cas9. Science 339, 823-826 (2013).
115. Yang, H. et al. *One-Step Generation of Mice Carrying Reporter and Conditional* Alleles by CRISPR/Cas-Mediated Genome Engineering. Cell 154, 1370-1379 (2013).
116. Kim, S., Kim, D., Cho, S. W., Kim, J. & Kim, J.-S. Highly efficient RNA-guided genome editing in human cells via delivery of purified Cas9 ribonucleoproteins. Genome Res. 24, 1012-1019 (2014).
117. Orlando, S. J. et al. Zinc-finger nuclease-driven targeted integration into mammalian genomes using donors with limited chromosomal homology. Nucleic Acids Res. 38, e152-e152 (2010).
118. Tsai, S. Q. et al. GUIDE-seq enables genome-wide profiling of off-target cleavage by CRISPR-Cas nucleases. Nat. Biotechnol. 33, 187-197 (2015).
119. Suzuki, K. et al. In vivo genome editing via CRISPR/Cas9 mediated homology-independent targeted integration. Nature 540, 144-149 (2016).
120. Kosicki, M., Tomberg, K. & Bradley, A. Repair of double-strand breaks induced by CRISPR-Cas9 leads to large deletions and complex rearrangements. Nat. Biotechnol. 36, 765-771 (2018).
121. Haapaniemi, E., Botla, S., Persson, J., Schmierer, B. & Taipale, J. CRISPR-Cas9 genome editing induces a p53-mediated DNA damage response. Nat. Med. 24, 927-930 (2018).
122. Ihry, R. J. et al. p53 inhibits CRISPR-Cas9 engineering in human pluripotent stem cells. Nat. Med. 24, 939-946 (2018).
123. Chapman, J. R., Taylor, M. R. G. & Boulton, S. J. Playing the end game: DNA double-strand break repair pathway choice. Mol. Cell 47, 497-510 (2012).
124. Cox, D. B. T., Platt, R. J. & Zhang, F. Therapeutic genome editing: prospects and challenges. Nat. Med. 21, 121-131 (2015).
125. Paquet, D. et al. Efficient introduction of specific homozygous and heterozygous mutations using CRISPR/Cas9. Nature 533, 125-129 (2016).
126. Chu, V. T. et al. Increasing the efficiency of homology-directed repair for CRISPR-Cas9-induced precise gene editing in mammalian cells. Nat. Biotechnol. 33, 543-548 (2015).
127. Maruyama, T. et al. Increasing the efficiency of precise genome editing with CRISPR-Cas9 by inhibition of non-homologous end joining. Nat. Biotechnol. 33, 538-542 (2015).
128. Rees, H. A., Yeh, W.-H. & Liu, D. R. Development of hRad51-Cas9 nickase fusions that mediate HDR without double-stranded breaks. Nat. Commun. 10, 1-12 (2019).
129. Komor, A. C., Kim, Y. B., Packer, M. S., Zuris, J. A. & Liu, D. R. Programmable editing of a target base in genomic DNA without double-stranded DNA cleavage. Nature 533, 420-424 (2016).
130. Gaudelli, N. M. et al. Programmable base editing of A.T to G.C in genomic DNA without DNA cleavage. Nature 551, 464-471 (2017).
131. Gao, X. et al. Treatment of autosomal dominant hearing loss by in vivo delivery of genome editing agents. Nature 553, 217-221 (2018).
132. Ingram, V. M. A specific chemical difference between the globins of normal human and sickle-cell anaemia haemoglobin. Nature 178, 792-794 (1956).
133. Myerowitz, R. & Costigan, F. C. The major defect in Ashkenazi Jews with Tay-Sachs disease is an insertion in the gene for the alpha-chain of beta-hexosaminidase. J. Biol. Chem. 263, 18587-18589 (1988).
134. Zielenski, J. Genotype and Phenotype in Cystic Fibrosis. Respiration 67, 117-133 (2000).
135. Mead, S. et al. A Novel Protective Prion Protein Variant that Colocalizes with Kuru Exposure. N. Engl. J. Med. 361, 2056-2065 (2009).
136. Marraffini, L. A. & Sontheimer, E. J. CRISPR interference limits horizontal gene transfer in staphylococci by targeting DNA. Science 322, 1843-1845 (2008).
137. Barrangou, R. et al. CRISPR provides acquired resistance against viruses in prokaryotes.
Science 315, 1709-1712 (2007).
138. Jiang, F. & Doudna, J. A. CRISPR-Cas9 Structures and Mechanisms. Annu. Rev. Biophys. 46, 505-529 (2017).
139. Hille, F. et al. The Biology of CRISPR-Cas: Backward and Forward. *Cell* 172, 1239-1259 (2018).
140. Luan, D. D., Korman, M. H., Jakubczak, J. L. & Eickbush, T. H. Reverse transcription of R2Bm RNA is primed by a nick at the chromosomal target site: a mechanism for non-LTR retrotransposition. Cell 72, 595-605 (1993).
141. Liu, Y., Kao, H.-I. & Bambara, R. A. Flap endonuclease 1: a central component of DNA metabolism. Annu. Rev. Biochem. 73, 589-615 (2004).
142. Rees, H. A. & Liu, D. R. Base editing: precision chemistry on the genome and transcriptome of living cells. Nat. Rev. Genet. 19, 770 (2018).

143. Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. Nat. Biotechnol. 34, 339-344 (2016).

144. Qi, L. S. et al. Repurposing CRISPR as an RNA-Guided Platform for Sequence-Specific Control of Gene Expression. Cell 152, 1173-1183 (2013).

145. Shechner, D. M., Hacisuleyman, E., Younger, S. T. & Rinn, J. L. Multiplexable, locus-specific targeting of long RNAs with CRISPR-Display. Nat. Methods 12, 664-670 (2015).

146. Tang, W., Hu, J. H. & Liu, D. R. Aptazyme-embedded guide RNAs enable ligand-responsive genome editing and transcriptional activation. Nat. Commun. 8, 15939 (2017).

147. Jinek, M. et al. Structures of Cas9 Endonucleases Reveal RNA-Mediated Conformational Activation. Science 343, 1247997 (2014).

148. Nishimasu, H. et al. Crystal Structure of Cas9 in Complex with Guide RNA and Target DNA. Cell 156, 935-949 (2014).

149. Jiang, F., Zhou, K., Ma, L., Gressel, S. & Doudna, J. A. A Cas9-guide RNA complex preorganized for target DNA recognition. Science 348, 1477-1481 (2015).

150. Baranauskas, A. et al. Generation and characterization of new highly thermostable and processive M-MuLV reverse transcriptase variants. Protein Eng. Des. Sel. 25, 657-668 (2012).

151. Gerard, G. F. et al. The role of template-primer in protection of reverse transcriptase from thermal inactivation. Nucleic Acids Res. 30, 3118-3129 (2002).

152. Arezi, B. & Hogrefe, H. Novel mutations in Moloney Murine Leukemia Virus reverse transcriptase increase thermostability through tighter binding to template-primer. Nucleic Acids Res. 37, 473-481 (2009).

153. Kotewicz, M. L., Sampson, C. M., D'Alessio, J. M. & Gerard, G. F. Isolation of cloned Moloney murine leukemia virus reverse transcriptase lacking ribonuclease H activity. Nucleic Acids Res. 16, 265-277 (1988).

154. Shen, M. W. et al. Predictable and precise template-free CRISPR editing of pathogenic variants. Nature 563, 646-651 (2018).

155. Thuronyi, B. W. et al. Continuous evolution of base editors with expanded target compatibility and improved activity. Nat. Biotechnol. (2019). doi:10.1038/s41587-019-0193-0

156. Kim, Y. B. et al. Increasing the genome-targeting scope and precision of base editing with engineered Cas9-cytidine deaminase fusions. Nat. Biotechnol. 35, 371-376 (2017).

157. Koblan, L. W. et al. Improving cytidine and adenine base editors by expression optimization and ancestral reconstruction. Nat. Biotechnol. (2018). doi:10.1038/nbt.4172

158. Komor, A. C. et al. Improved base excision repair inhibition and bacteriophage Mu Gam protein yields C:G-to-T:A base editors with higher efficiency and product purity. Sci. Adv. 3, eaao4774 (2017).

159. Kleinstiver, B. P. et al. High-fidelity CRISPR-Cas9 nucleases with no detectable genome-wide off-target effects. Nature 529, 490-495 (2016).

160. Zuo, E. et al. Cytosine base editor generates substantial off-target single-nucleotide variants in mouse embryos. Science 364, 289-292 (2019).

161. Jin, S. et al. Cytosine, but not adenine, base editors induce genome-wide off-target mutations in rice. Science 364, 292-295 (2019).

162. Kim, D., Kim, D., Lee, G., Cho, S.-I. & Kim, J.-S. Genome-wide target specificity of CRISPR RNA-guided adenine base editors. Nat. Biotechnol. 37, 430-435 (2019).

163. Grünewald, J. et al. Transcriptome-wide off-target RNA editing induced by CRISPR-guided DNA base editors. Nature 569, 433-437 (2019).

164. Zhou, C. et al. Off-target RNA mutation induced by DNA base editing and its elimination by mutagenesis. Nature 571, 275-278 (2019).

165. Rees, H. A., Wilson, C., Doman, J. L. & Liu, D. R. Analysis and minimization of cellular RNA editing by DNA adenine base editors. Sci. Adv. 5, eaax5717 (2019).

166. Ostertag, E. M. & Kazazian Jr, H. H. Biology of Mammalian L1 Retrotransposons. Annu. Rev. Genet. 35, 501-538 (2001).

167. Griffiths, D. J. Endogenous retroviruses in the human genome sequence. Genome Biol. 2, REVIEWS1017 (2001).

168. Berkhout, B., Jebbink, M. & Zsíros, J. Identification of an Active Reverse Transcriptase Enzyme Encoded by a Human Endogenous HERV-K Retrovirus. J. Virol. 73, 2365-2375 (1999).

169. Halvas, E. K., Svarovskaia, E. S. & Pathak, V. K. Role of Murine Leukemia Virus Reverse Transcriptase Deoxyribonucleoside Triphosphate-Binding Site in Retroviral Replication and In Vivo Fidelity. J. Virol. 74, 10349-10358 (2000).

170. Dever, D. P. et al. CRISPR/Cas9 Beta-globin Gene Targeting in Human Hematopoietic Stem Cells. Nature 539, 384-389 (2016).

171. Park, S. H. et al. Highly efficient editing of the β-globin gene in patient-derived hematopoietic stem and progenitor cells to treat sickle cell disease. Nucleic Acids Res. doi:10.1093/nar/gkz475

172. Collinge, J. Prion diseases of humans and animals: their causes and molecular basis. Annu. Rev. Neurosci. 24, 519-550 (2001).

173. Asante, E. A. et al. A naturally occurring variant of the human prion protein completely prevents prion disease. Nature 522, 478-481 (2015).

174. Anzalone, A. V., Lin, A. J., Zairis, S., Rabadan, R. & Cornish, V. W. Reprogramming eukaryotic translation with ligand-responsive synthetic RNA switches. Nat. Methods 13, 453-458 (2016).

175. Badran, A. H. et al. Continuous evolution of *Bacillus thuringiensis* toxins overcomes insect resistance. Nature 533, 58-63 (2016).

176. Anders, C. & Jinek, M. Chapter One—In Vitro Enzymology of Cas9. in Methods in Enzymology (eds. Doudna, J. A. & Sontheimer, E. J.) 546, 1-20 (Academic Press, 2014).
177. Pirakitikulr, N., Ostrov, N., Peralta-Yahya, P. & Cornish, V. W. PCRless library mutagenesis via oligonucleotide recombination in yeast. Protein Sci. Publ. Protein Soc. 19, 2336-2346 (2010).
178. Clement, K. et al. CRISPResso2 provides accurate and rapid genome editing sequence analysis. Nat. Biotechnol. 37, 224-226 (2019).
179. Tsai, S. Q. et al. GUIDE-seq enables genome-wide profiling of off-target cleavage by CRISPR-Cas nucleases. Nat. Biotechnol. 33, 187-197 (2015).

180. Kleinstiver, B. P. et al. High-fidelity CRISPR-Cas9 nucleases with no detectable genome-wide off-target effects. Nature 529, 490-495 (2016).
181. Koblan, L. W. et al. Improving cytidine and adenine base editors by expression optimization and ancestral reconstruction. Nat. Biotechnol. (2018). doi:10.1038/nbt.4172
182. Baranauskas, A. et al. Generation and characterization of new highly thermostable and processive M-MuLV reverse transcriptase variants. Protein Eng. Des. Sel. 25, 657-668 (2012).
183. Schechner, D M, Hacisuleyman E., Younger S T, Rinn J L. Nat Methods 664-70 (2015).
184. Brown J A, et al. Nat Struct Mol Biol 633-40 (2014).
185. Conrad N A and Steitz J A. EMBO J 1831-41 (2005).
186. Bartlett J S, et al. Proc Natl Acad Sci USA 8852-7 (1996).
187. Mitton-Fry R M, DeGregorio S J, Wang J, Steitz T A, Steitz J A. Science 1244-7 (2010).
188. Forster A C, Symons R H. Cell. 1987.
189. Weinberg Z, Kim P B, Chen T H, Li S, Harris K A, Lünse C E, Breaker R R. Nat. Chem. Biol. 2015.
190. Feldstein P A, Buzayan J M, Bruening G. Gene 1989.
191. Saville B J, Collins R A. Cell. 1990.
192. Roth A, Weinberg Z, Chen A G, Kim P G, Ames T D, Breaker R R. Nat Chem Biol. 2013.
193. Borchardt E K, et al. RNA 1921-30 (2015).
194. Zhang Y, et al. Mol Cell 792-806 (2013).
195. Dang Y, et al. Genome Biol 280 (2015).
196. Schaefer M, Kapoor U, and Jantsch M F. Open Biol 170077 (2017).
197. Nahar S, et al. Chem Comm 2377-80 (2018).
198. Gao Y and Zhao Y. J Integr Plant Biol 343-9 (2014).
199. Dubois N, Marquet R, Paillart J, Bernacchi S. Front Microbiol 527 (2018).
200. Costa M and Michel F. EMBO J 1276-85 (1995).
201. Hu J H, et al. Nature 57-63 (2018).
202. Furukawa K, Gu H, Breaker R R. Methods Mol Biol 209-20 (2014).
203. Zettler, J., Schütz, V. & Mootz, H. D. The naturally split Npu DnaE intein exhibits an extraordinarily high rate in the protein trans-splicing reaction. FEBS Lett. 583, 909-914 (2009).
204. Kugler, S., Kilic, E. & Bähr, M. Human synapsin 1 gene promoter confers highly neuron-specific long-term transgene expression from an adenoviral vector in the adult rat brain depending on the transduced area. Gene Ther. 10, 337-347 (2003).
205. de Felipe, P., Hughes, L. E., Ryan, M. D. & Brown, J. D. Co-translational, intraribosomal cleavage of polypeptides by the foot-and-mouth disease virus 2A peptide. J. Biol. Chem. 278, 11441-11448 (2003).
206. Levy, J. M. & Nicoll, R. A. Membrane-associated guanylate kinase dynamics reveal regional and developmental specificity of synapse stability. J. Physiol. 595, 1699-1709 (2017).
207. Li, B. & Dewey, C. N. RSEM: accurate transcript quantification from RNA-Seq data with or without a reference genome. BMC Bioinformatics 12, 323 (2011).
208. Ritchie, M. E. et al. limma powers differential expression analyses for RNA-sequencing and microarray studies. Nucleic Acids Res. 43, e47-e47 (2015).

EMBODIMENTS

The following embodiments are within the scope of the present disclosure. Furthermore, the disclosure encompasses all variations, combinations, and permutations of these embodiments in which one or more limitations, elements, clauses, and descriptive terms from one or more of the listed embodiments is introduced into another listed embodiment in this section. For example, any listed embodiment that is dependent on another embodiment can be modified to include one or more limitations found in any other listed embodiment in this section that is dependent on the same base embodiment. Where elements are presented as lists, e.g., in Markush group format, each subgroup of the elements is also disclosed, and any element(s) can be removed from the group. It should it be understood that, in general, where the disclosure, or aspects of the disclosure, is/are referred to as comprising particular elements and/or features, certain embodiments of the invention or aspects of the invention consist, or consist essentially of, such elements and/or features. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

Group 1. Embodiments 1-212

1. A fusion protein comprising a nucleic acid programmable DNA binding protein (napDNAbp) and a reverse transcriptase.
2. The fusion protein of embodiment 1, wherein the fusion protein is capable of carrying out genome editing by target-primed reverse transcription in the presence of an extended guide RNA.
3. The fusion protein of embodiment 1, wherein the napDNAbp has a nickase activity.
4. The fusion protein of embodiment 1, wherein the napDNAbp is a Cas9 protein or variant thereof.
5. The fusion protein of embodiment 1, wherein the napDNAbp is a nuclease active Cas9, a nuclease inactive Cas9 (dCas9), or a Cas9 nickase (nCas9).
6. The fusion protein of embodiment 1, wherein the napDNAbp is Cas9 nickase (nCas9).
7. The fusion protein of embodiment 1, wherein the napDNAbp is selected from the group consisting of: Cas9, CasX, CasY, Cpf1, C2c1, C2c2, C2C3, and Argonaute and optionally has a nickase activity.
8. The fusion protein of embodiment 1, wherein the fusion protein when complexed with an extended guide RNA is capable of binding to a target DNA sequence.
9. The fusion protein of embodiment 8, wherein the target DNA sequence comprises a target strand and a complementary non-target strand.
10. The fusion protein of embodiment 8, wherein the binding of the fusion protein complexed to the extended guide RNA forms an R-loop.
11. The fusion protein of embodiment 10, wherein the R-loop comprises (i) an RNA-DNA hybrid comprising the extended guide RNA and the target strand, and (ii) the complementary non-target strand.
12. The fusion protein of embodiment 11, wherein the complementary non-target strand is nicked to form a reverse transcriptase priming sequence having a free 3' end.

13. The fusion protein of embodiment 2, wherein the extended guide RNA comprises (a) a guide RNA, and (b) an RNA extension at the 5' or the 3' end of the guide RNA, or at an intramolecular location in the guide RNA.
14. The fusion protein of embodiment 13, wherein the RNA extension comprises (i) a reverse transcription template sequence comprising a desired nucleotide change, (ii) a reverse transcription primer binding site, and (iii) optionally, a linker sequence.
15. The fusion protein of embodiment 14, wherein the reverse transcription template sequence encodes a single-strand DNA flap that is complementary to an endogenous DNA sequence adjacent to the nick site, wherein the single-strand DNA flap comprises the desired nucleotide change.
16. The fusion protein of embodiment 13, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.
17. The fusion protein of embodiment 15, wherein the single-strand DNA flap hybridizes to the endogenous DNA sequence adjacent to the nick site, thereby installing the desired nucleotide change.
18. The fusion protein of embodiment 15, wherein the single-stranded DNA flap displaces the endogenous DNA sequence adjacent to the nick site and which has a free 5' end.
19. The fusion protein of embodiment 18, wherein the endogenous DNA sequence having the 5' end is excised by the cell.
20. The fusion protein of embodiment 18, wherein cellular repair of the single-strand DNA flap results in installation of the desired nucleotide change, thereby forming a desired product.
21. The fusion protein of embodiment 14, wherein the desired nucleotide change is installed in an editing window that is between about −4 to +10 of the PAM sequence, or between about −10 to +20 of the PAM sequence, or between about −20 to +40 of the PAM sequence, or between about −30 to +100 of the PAM sequence, or wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.
22. The fusion protein of embodiment 1, wherein the napDNAbp comprises an amino acid sequence of SEQ ID NO: 18, or an amino acid sequence that is at least 80%, 85%, 90%, 95%, 98%, or 99% identical to the amino acid sequence to SEQ ID NO: 18.
23. The fusion protein of embodiment 1, wherein the napDNAbp comprises an amino acid sequence that is at least 80%, 85%, 90%, 95%, 98%, or 99% identical to the amino acid sequence of any one of SEQ ID NOs: 18-88, 126, 130, 137, 141, 147, 153, 157, 445, 460, 467, and 482-487.
24. The fusion protein of embodiment 1, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.
25. The fusion protein of embodiment 1, wherein the reverse transcriptase comprises an amino acid sequence that is at least 80%, 85%, 90%, 95%, 98%, or 99% identical to the amino acid sequence of any one of SEQ ID NOs: 89-100, 105-122, 128-129, 132, 139, 143, 149, 154, 159, 235, 454, 471, 516, 662, 700, 701-716, 739-741, and 766.
26. The fusion protein of embodiment 1, wherein the reverse transcriptase is a naturally-occurring reverse transcriptase from a retrovirus or a retrotransposon.
27. The fusion protein of any one of the previous embodiments, wherein the fusion protein comprises the structure NH$_2$-[napDNAbp]-[reverse transcriptase]-COOH; or NH$_2$-[reverse transcriptase]-[napDNAbp]-COOH, wherein each instance of "]-[" indicates the presence of an optional linker sequence.
28. The fusion protein of embodiment 27, wherein the linker sequence comprises an amino acid sequence of SEQ ID NOs: 127, 165-176, 446, 453, and 767-769.
29. The fusion protein of embodiment 14, wherein the desired nucleotide change is a single nucleotide change, an insertion of one or more nucleotides, or a deletion of one or more nucleotides.
30. The fusion protein of embodiment 29, wherein the insert or deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, or at least 50.
31. An extended guide RNA comprising a guide RNA and at least one RNA extension.
32. The extended guide RNA of embodiment 1, wherein the RNA extension is position at the 3' or 5' end of the guide RNA, or at an intramolecular position in the guide RNA.
33. The extended guide RNA of embodiment 31, wherein the extended guide RNA is capable of binding to a napDNAbp and directing the napDNAbp to a target DNA sequence.
34. The extended guide RNA of embodiment 33, wherein the target DNA sequence comprises a target strand and a complementary non-target strand, wherein the guide RNA hybridizes to the target strand to form an RNA-DNA hybrid and an R-loop.
35. The extended guide RNA of embodiment 31, wherein the at least one RNA extension comprises (i) a reverse transcription template sequence, (ii) a reverse transcription primer binding site, and (iii) optionally a linker sequence.
36. The extended guide RNA of embodiment 35, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

37. The extended guide RNA of embodiment 35, wherein the reverse transcription template sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

38. The extended guide RNA of embodiment 35, wherein the reverse transcription primer binding site sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

39. The extended guide RNA of embodiment 35, wherein the optional linker sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

40. The extended guide RNA of embodiment 35, wherein the reverse transcription template sequence encodes a single-strand DNA flap that is complementary to an endogenous DNA sequence adjacent to a nick site, wherein the single-strand DNA flap comprises a desired nucleotide change.

41. The extended guide RNA of embodiment 40, wherein the single-stranded DNA flap displaces an endogenous single-strand DNA having a 5' end in the target DNA sequence that has been nicked, and wherein the endogenous single-strand DNA is immediately adjacent downstream of the nick site.

42. The extended guide RNA of embodiment 41, wherein the endogenous single-stranded DNA having the free 5' end is excised by the cell.

43. The extended guide RNA of embodiment 41, wherein cellular repair of the single-strand DNA flap results in installation of the desired nucleotide change, thereby forming a desired product.

44. The extended guide RNA of embodiment 31, comprising the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

45. The extended guide RNA of embodiment 35, wherein the reverse transcription template sequence comprises a nucleotide sequence that is at least 80%, or 85%, or 90%, or 95%, or 99% identical to the endogenous DNA target.

46. The extended guide RNA of embodiment 35, wherein the reverse transcription primer binding site hybridizes with a free 3' end of the cut DNA.

47. The extended guide RNA of embodiment 35, wherein the optional linker sequence is at least 1 nucleotide, or at least 2, at least 3, at least 4, at least 5, at least 6, at least 7, at least 8, at least 9, at least 10, at least 11, at least 12, at least 13, at least 14, or at least 15 nucleotides in length.

48. A complex comprising comprising a fusion protein of any one of embodiments 1-30 and an extended guide RNA.

49. The complex of embodiment 48, wherein the extended guide RNA comprises a guide RNA and an RNA extension at the 3' or 5' end of the guide RNA or at an intramolecular position in the guide RNA.

50. The complex of embodiment 48, wherein the extended guide RNA is capable of binding to a napDNAbp and directing the napDNAbp to a target DNA sequence.

51. The complex of embodiment 50, wherein the target DNA sequence comprises a target strand and a complementary non-target strand, wherein the guide RNA hybridizes to the target strand to form an RNA-DNA hybrid and an R-loop.

52. The complex of embodiment 49, wherein the at least one RNA extension comprises (i) a reverse transcription template sequence, (ii) a reverse transcription primer binding site, and (iii) optionally a linker sequence.

53. The complex of embodiment 48, wherein the extended guide RNA comprises the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

54. The complex of embodiment 52, wherein the reverse transcription template sequence comprises a nucleotide sequence having at least 80%, or 85%, or 90%, or 95%, or 99% sequence identity with the endogenous DNA target.

55. The complex of embodiment 52, wherein the reverse transcription primer binding site hybridizes with a free 3' end of the cut DNA.

56. A complex comprising comprising a napDNAbp and an extended guide RNA.

57. The complex of embodiment 56, wherein the napDNAbp is a Cas9 nickase.

58. The complex of embodiment 56, wherein the napDNAbp comprises an amino acid sequence of SEQ ID NO: 18, or an amino acid sequence having at least 80%, 85%, 90%, 95%, 98%, or 99% sequence identity with SEQ ID NO: 18.

59. The complex of embodiment 57, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

60. The complex of embodiment 57, wherein the extended guide RNA comprises a guide RNA and an RNA extension at the 3' or 5' end of the guide RNA, or at an intramolecular position in the guide RNA.

61. The complex of embodiment 57, wherein the extended guide RNA is capable of directing the napDNAbp to a target DNA sequence.

62. The complex of embodiment 61, wherein the target DNA sequence comprises a target strand and a complementary non-target strand, wherein the spacer sequence hybridizes to the target strand to form an RNA-DNA hybrid and an R-loop.

63. The complex of embodiment 61, wherein the RNA extension comprises (i) a reverse transcription template sequence, (ii) a reverse transcription primer binding site, and (iii) optionally a linker sequence.

64. The complex of embodiment 57, wherein the extended guide RNA comprises the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

65. The complex of embodiment 63, wherein the reverse transcription template sequence comprises a nucleotide sequence that is at least 80%, or 85%, or 90%, or 95%, or 99% identical to the endogenous DNA target.

66. The complex of embodiment 63, wherein the reverse transcription primer binding site hybridizes with a free 3' end of the cut DNA.

67. The complex of embodiment 63, wherein the optional linker sequence is at least 1 nucleotide, or at least 2, at least 3, at least 4, at least 5, at least 6, at least 7, at least 8, at least 9, at least 10, at least 11, at least 12, at least 13, at least 14, or at least 15 nucleotides in length.

68. A polynucleotide encoding the fusion protein of any of embodiments 1-30.

69. A vector comprising the polynucleotide of embodiment 68.

70. A cell comprising the fusion protein of any of embodiments 1-30 and an extended guide RNA bound to the napDNAbp of the fusion protein.

71. A cell comprising a complex of any one of embodiments 48-67.

72. A pharmaceutical composition comprising: (i) a fusion protein of any of embodiments 1-30, the complex of embodiments 48-67, the polynucleotide of embodiment 68, or the vector of embodiment 69; and (ii) a pharmaceutically acceptable excipient.

73. A pharmaceutical composition comprising: (i) the complex of embodiments 48-67 (ii) reverse transcriptase provided in trans; and (iii) a pharmaceutically acceptable excipient.

74. A kit comprising a nucleic acid construct, comprising: (i) a nuleic acid sequencing encoding the fusion protein of any one of embodiments 1-30; and (ii) a promoter that drives expression of the sequence of (i).

75. A method for installing a desired nucleotide change in a double-stranded DNA sequence, the method comprising:
    (i) contacting the double-stranded DNA sequence with a complex comprising a fusion protein and an extended guide RNA, wherein the fusion protein comprises a napDNAbp and a reverse transcriptase and wherein the extended guide RNA comprises a reverse transcription template sequence comprising the desired nucleotide change;
    (ii) nicking the double-stranded DNA sequence on the non-target strand, thereby generating a free single-strand DNA having a 3' end;
    (iii) hybridizing the 3' end of the free single-strand DNA to the reverse transcription template sequence, thereby priming the reverse transcriptase domain;
    (iv) polymerizing a strand of DNA from the 3' end, thereby generating a single-strand DNA flap comprising the desired nucleotide change;
    (v) replacing an endogenous DNA strand adjacent the cut site with the single-strand DNA flap, thereby installing the desired nucleotide change in the double-stranded DNA sequence.

76. The method of embodiment 75, wherein the step of (v) replacing comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

77. The method of embodiment 76, wherein the desired nucleotide change is a single nucleotide substitution, a deletion, or an insertion.

78. The method of embodiment 77, wherein the single nucleotide substitution is a transition or a transversion.

79. The method of embodiment 76, wherein the desired nucleotide change is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

80. The method of embodiment 76, wherein the desired nucleoid change converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

81. The method of embodiment 76, wherein the desired nucleotide change is an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

82. The method of embodiment 76, wherein the desired nucleotide change corrects a disease-associated gene.

83. The method of embodiment 82, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease.

84. The method of embodiment 82, wherein the disease-associated gene is associated with a polygenic disorder selected from the group consisting of: heart disease; high blood pressure; Alzheimer's disease; arthritis; diabetes; cancer; and obesity.

85. The method of embodiment 76, wherein the napDNAbp is a nuclease dead Cas9 (dCas9), a Cas9 nickase (nCas9), or a nuclease active Cas9.

86. The method of embodiment 76, wherein the napDNAbp comprises an amino acid sequence of SEQ ID NO: 18.

87. The method of embodiment 76, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

88. The method of embodiment 76, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

89. The method of embodiment 76, wherein the reverse transcriptase domain comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

90. The method of embodiment 76, wherein the extended guide RNA comprises an RNA extension at the 3' or 5' ends or at an intramolecular location in the guide RNA, wherein the RNA extension comprises the reverse transcription template sequence.

91. The method of embodiment 90, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

92. The method of embodiment 76, wherein the extended guide RNA has a nucleotide sequence selected from the group consisting of SEQ ID NOs: 394, 429-442, 641-649, 678-692, 2997-3103, 3113-3121, 3305-3455, 3479-3493, 3522-3556, 3628-3698, and 3755-3810.

93. A method for introducing one or more changes in the nucleotide sequence of a DNA molecule at a target locus, comprising:
(i) contacting the DNA molecule with a nucleic acid programmable DNA binding protein (napDNAbp) and a guide RNA which targets the napDNAbp to the target locus, wherein the guide RNA comprises a reverse transcriptase (RT) template sequence comprising at least one desired nucleotide change;
(ii) forming an exposed 3' end in a DNA strand at the target locus;
(iii) hybridizing the exposed 3' end to the RT template sequence to prime reverse transcription;
(iv) synthesizing a single strand DNA flap comprising the at least one desired nucleotide change based on the RT template sequence by reverse transcriptase;
(v) and incorporating the at least one desired nucleotide change into the corresponding endogenous DNA, thereby introducing one or more changes in the nucleotide sequence of the DNA molecule at the target locus.

94. The method of embodiment 93, wherein the one or more changes in the nucleotide sequence comprises a transition.

95. The method of embodiment 94, wherein the transition is selected from the group consisting of: (a) T to C; (b) A to G; (c) C to T; and (d) G to A.

96. The method of embodiment 93, wherein the one or more changes in the nucleotide sequence comprises a transversion.

97. The method of embodiment 96, wherein the transversion is selected from the group consisting of: (a) T to A; (b) T to G; (c) C to G; (d) C to A; (e) A to T; (f) A to C; (g) G to C; and (h) G to T.

98. The method of embodiment 93, wherein the one or more changes in the nucleotide sequence comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

99. The method of embodiment 93, wherein the one or more changes in the nucleotide sequence comprises an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

100. The method of embodiment 93, wherein the one or more changes in the nucleotide sequence comprises a correction to a disease-associated gene.

101. The method of embodiment 100, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease.

102. The method of embodiment 100, wherein the disease-associated gene is associated with a polygenic disorder selected from the group consisting of: heart disease; high blood pressure; Alzheimer's disease; arthritis; diabetes; cancer; and obesity.

103. The method of embodiment 93, wherein the napDNAbp is a nuclease active Cas9 or variant thereof.

104. The method of embodiment 93, wherein the napDNAbp is a nuclease inactive Cas9 (dCas9) or Cas9 nickase (nCas9), or a variant thereof.

105. The method of embodiment 93, wherein the napDNAbp comprises an amino acid sequence of SEQ ID NO: 18.

106. The method of embodiment 93, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

107. The method of embodiment 93, wherein the reverse transcriptase is introduced in trans.

108. The method of embodiment 93, wherein the napDNAbp comprises a fusion to a reverse transcriptase.

109. The method of embodiment 93, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

110. The method of embodiment 93, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

111. The method of embodiment 93, wherein the step of forming an exposed 3' end in the DNA strand at the target locus comprises nicking the DNA strand with a nuclease.

112. The method of embodiment 111, wherein the nuclease is the napDNAbp, is provided as a fusion domain of napDNAbp, or is provided in trans.

113. The method of embodiment 93, wherein the step of forming an exposed 3' end in the DNA strand at the target locus comprises contacting the DNA strand with a chemical agent.

114. The method of embodiment 93, wherein the step of forming an exposed 3' end in the DNA strand at the target locus comprises introducing a replication error.

115. The method of embodiment 93, wherein the step of contacting the DNA molecule with the napDNAbp and the guide RNA forms an R-loop.

116. The method of embodiment 115, wherein the DNA strand in which the exposed 3' end is formed is in the R-loop.

117. The method of embodiment 93, wherein guide RNA comprises an extended portion that comprises the reverse transcriptase (RT) template sequence.

118. The method of embodiment 117, wherein the extended portion is at the 3' end of the guide RNA, the 5' end of the guide RNA, or at an intramolecular position in the guide RNA.

119. The method of embodiment 93, wherein the guide RNA further comprises a primer binding site.

120. The method of embodiment 93, wherein the guide RNA further comprises a spacer sequence.

121. The method of embodiment 93, wherein the RT template sequence is homologous to the corresponding endogenous DNA.

122. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change; (b) conducting target-primed reverse transcription of the RT template to generate a single strand DNA comprising the desired nucleotide change; and (c) incorporating the desired nucleotide change into the DNA molecule at the target locus through a DNA repair and/or replication process.

123. The method of embodiment 122, wherein the RT template is located at the 3' end of the guide RNA, the 5' end of the guide RNA, or at an intramolecular location in the guide RNA.

124. The method of embodiment 122, wherein the desired nucleotide change comprises a transition, a transversion, an insertion, or a deletion, or any combination thereof.

125. The method of claim 122, wherein the desired nucleotide change comprises a transition selected from the group consisting of: (a) T to C; (b) A to G; (c) C to T; and (d) G to A.

126. The method of claim 122, wherein the desired nucleotide change comprises a transversion selected from the group consisting of: (a) T to A; (b) T to G; (c) C to G; (d) C to A; (e) A to T; (f) A to C; (g) G to C; and (h) G to T.

127. The method of embodiment 122, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

128. A polynucleotide encoding the extended guide RNA of any one of embodiments 31-47.

129. A vector comprising the polynucleotide of embodiment 128.

130. A cell comprising the vector of embodiment 129.

131. The fusion protein of any of embodiments 1-30, wherein the reverse transcriptase is an error-prone reverse transcriptase.

132. A method for mutagenizing a DNA molecule at a target locus by target-primed reverse transcription, the method comprising: (a) contacting the DNA molecule at the target locus with a (i) fusion protein comprising a nucleic acid programmable DNA binding protein (napDNAbp) and an error-prone reverse transcriptase and (ii) a guide RNA comprising an RT template comprising a desired nucleotide change; (b) conducting target-primed reverse transcription of the RT template to generate a mutagenized single strand DNA; and (c) incorporating the mutagenized single strand DNA into the DNA molecule at the target locus through a DNA repair and/or replication process.

133. The method of embodiment 132, wherein the fusion protein comprises the amino acid sequence of PE1, PE2, or PE3.

134. The method of embodiment 132, wherein the napDNAbp is a Cas9 nickase (nCas9).

135. The method of embodiment 132, wherein the napDNAbp comprises the amino acid sequence of SEQ ID NOs: 18-88, 126, 130, 137, 141, 147, 153, 157, 445, 460, 467, and 482-487.

136. The method of embodiment 132, wherein the guide RNA comprises SEQ ID NO: 222.

137. The method of embodiment 132, wherein the step of (b) conducting target-primed reverse transcription comprises generating a 3' end primer binding sequence at the target locus that is capable of priming reverse transcription by annealing to a primer binding site on the guide RNA.

138. A method for replacing a trinucleotide repeat expansion mutation in a target DNA molecule with a healthy sequence comprising a healthy number of repeat trinucleotides, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising the replacement sequence, wherein said fusion protein intr; (b) conducting target-primed reverse transcription of the RT template to generate a single strand DNA comprising the replacement sequence; and (c) incorporating the single strand DNA into the DNA molecule at the target locus through a DNA repair and/or replication process.

139. The method of embodiment 138, wherein the fusion protein comprises the amino acid sequence of PE1, PE2, or PE3.

140. The method of embodiment 138, wherein the napDNAbp is a Cas9 nickase (nCas9).

141. The method of embodiment 138, wherein the napDNAbp comprises the amino acid sequence of SEQ ID NOs: 18-88, 126, 130, 137, 141, 147, 153, 157, 445, 460, 467, and 482-487.

142. The method of embodiment 138, wherein the guide RNA comprises SEQ ID NO: 222.

143. The method of embodiment 138, wherein the step of (b) conducting target-primed reverse transcription comprises generating a 3' end primer binding sequence at the target locus that is capable of priming reverse transcription by annealing to a primer binding site on the guide RNA.

144. The method of embodiment 138, wherein the trinucleotide repeat expansion mutation is associated with Huntington's Disease, Fragile X syndrome, or Friedreich's ataxia.

145. The method of embodiment 138, wherein the trinucleotide repeat expansion mutation comprises a repeating unit of CAG triplets.

146. The method of embodiment 138, wherein the trinucleotide repeat expansion mutation comprises a repeating unit of GAA triplets.

147. A method of installing a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the functional moiety; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the functional moiety.

148. The method of embodiment 147, wherein functional moiety is peptide tag.

149. The method of embodiment 148, wherein the peptide tag is an affinity tag, solubilization tag, chromatography tag, epitope tag, or a fluorescence tag.

150. The method of embodiment 148, wherein the peptide tag is selected from the group consisting of: AviTag (SEQ ID NO: 245); C-tag (SEQ ID NO: 246); Calmodulin-tag (SEQ ID NO: 247); polyglutamate tag (SEQ ID NO: 248); E-tag (SEQ ID NO: 249); FLAG-tag (SEQ ID NO: 250); HA-tag (SEQ ID NO: 251); His-tag (SEQ ID NOs: 252-262); Myc-tag (SEQ ID NO: 263); NE-tag (SEQ ID NO: 264); Rho1D4-tag (SEQ ID NO: 265); S-tag (SEQ ID NO: 266); SBP-tag (SEQ ID NO: 267); Softag-1 (SEQ ID NO: 268); Softag-2 (SEQ ID NO: 269); Spot-tag (SEQ ID NO: 270); Strep-tag (SEQ ID NO: 271); TC tag (SEQ ID NO: 272); Ty tag (SEQ ID NO: 273); V5 tag (SEQ ID NO: 274); VSV-tag (SEQ ID NO: 275); and Xpress tag (SEQ ID NO: 276).

151. The method of embodiment 148, wherein the peptide tag is selected from the group consisting of: AU1 epitope (SEQ ID NO: 278); AU5 epitope (SEQ ID NO: 279); Bacteriophage T7 epitope (T7-tag) (SEQ ID NO: 280); Bluetongue virus tag (B-tag) (SEQ ID NO: 281); E2 epitope (SEQ ID NO: 282); Histidine affinity tag (HAT) (SEQ ID NO: 283); HSV epitope (SEQ ID NO: 284); Polyarginine (Arg-tag) (SEQ ID NO: 285); Polyaspartate (Asp-tag) (SEQ ID NO: 286); Polyphenylalanine (Phe-tag) (SEQ ID NO: 287); 51-tag (SEQ ID NO: 288); S-tag (SEQ ID NO: 289); and VSV-G (SEQ ID NO: 290).

152. The method of embodiment 147, wherein the functional moiety is an immunoepitope.

153. The method of embodiment 152, wherein the immunoepitope is selected from the group consisting of: tetanus toxoid (SEQ ID NO: 396); diphtheria toxin mutant CRM197 (SEQ ID NO: 398); mumps immunoepitope 1 (SEQ ID NO: 400); mumps immunoepitope 2 (SEQ ID NO: 402); mumps immunoepitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

154. The method of embodiment 147, wherein the functional moiety alters the localization of the protein of interest.

155. The method of embodiment 147, wherein the functional moiety is a degradation tag such that the degradation rate of the protein of interest is altered.

156. The method of embodiment 155, wherein the degradation tag comprises an amino acid sequence encoding the degradation tags as disclosed herein.

157. The method of embodiment 147, wherein the functional moiety is a small molecule binding domain.

158. The method of embodiment 157, wherein the small molecule binding domain is FKBP12 of SEQ ID NO: 488.

159. The method of embodiment 157, wherein the small molecule binding domain is FKBP12-F36V of SEQ ID NO: 489.

160. The method of embodiment 157, wherein the small molecule binding domain is cyclophilin of SEQ ID NOs: 490 and 493-494.

161. The method of embodiment 157, wherein the small molecule binding domain is installed in two or more proteins of interest.

162. The method of embodiment 161, wherein the two or more proteins of interest may dimerize upon contacting with a small molecule.

163. The method of embodiment 157, wherein the small molecule is a dimer of a small molecule selected from the group consisting of:

164. A method of installing an immunoepitope in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the immunoepitope.

165. The method of embodiment 164, wherein the immunoepitope is selected from the group consisting of: tetanus toxoid (SEQ ID NO: 396); diphtheria toxin mutant CRM197 (SEQ ID NO: 398); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

166. The method of embodiment 164, wherein the fusion protein comprises the amino acid sequence of PE1, PE2, or PE3.

167. The method of embodiment 164, wherein the napDNAbp is a Cas9 nickase (nCas9).

168. The method of embodiment 164, wherein the napDNAbp comprises the amino acid sequence of SEQ ID NOs: 18-88, 126, 130, 137, 141, 147, 153, 157, 445, 460, 467, and 482-487.

169. The method of embodiment 164, wherein the guide RNA comprises SEQ ID NO: 222.

170. A method of installing a small molecule dimerization domain in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the small molecule dimerization domain; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the small molecule dimerization domain.

171. The method of embodiment 170, further comprising conducting the method on a second protein of interest.

172. The method of embodiment 171, wherein the first protein of interest and the second protein of interest dimerize in the presence of a small molecule that binds to the dimerization domain on each of said proteins.

173. The method of embodiment 170, wherein the small molecule binding domain is FKBP12 of SEQ ID NO: 488.

174. The method of embodiment 170, wherein the small molecule binding domain is FKBP12-F36V of SEQ ID NO: 489.

175. The method of embodiment 170, wherein the small molecule binding domain is cyclophilin of SEQ ID NOs: 490 and 493-494.

176. The method of embodiment 170, wherein the small molecule is a dimer of a small molecule selected from the group consisting of:

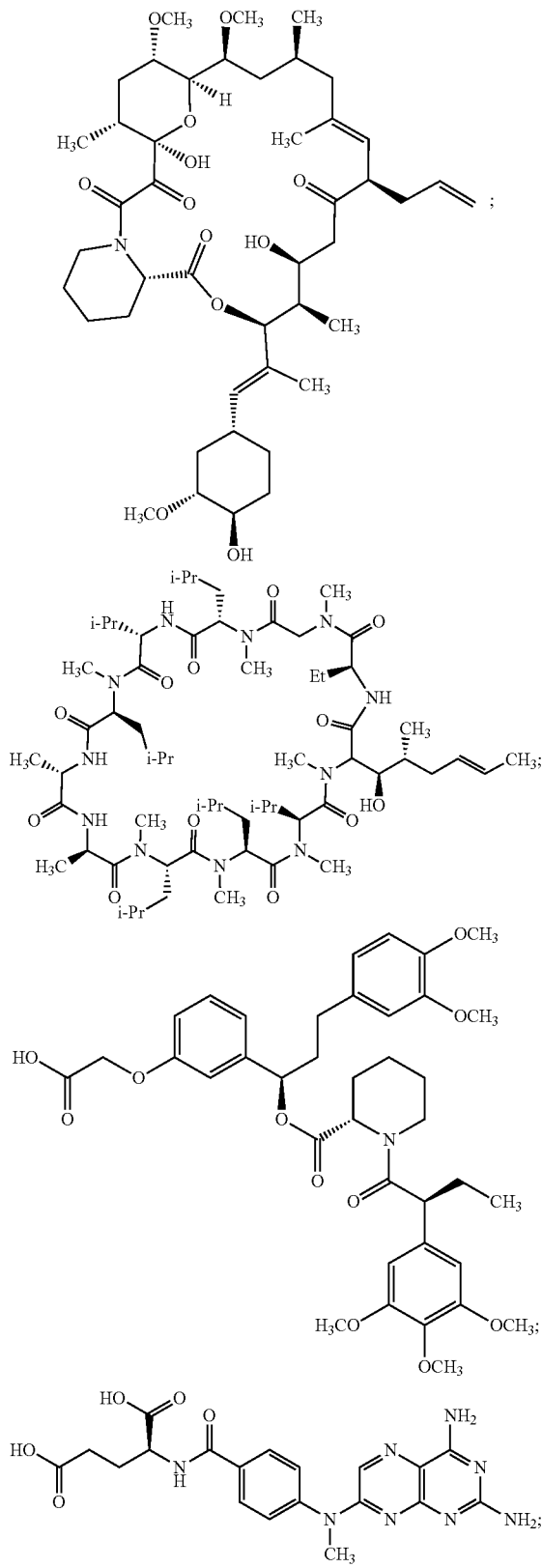

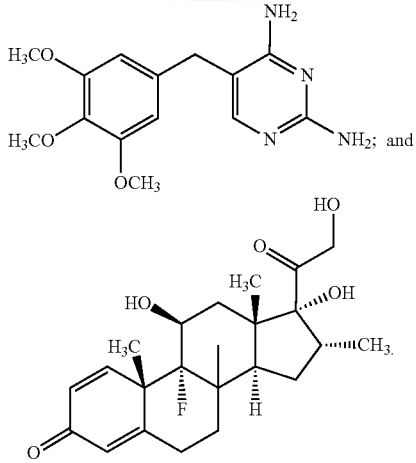

177. The method of embodiment 170, wherein the fusion protein comprises the amino acid sequence of PE1, PE2, or PE3.
178. The method of embodiment 170, wherein the napD-NAbp is a Cas9 nickase (nCas9).
179. The method of embodiment 170, wherein the napD-NAbp comprises the amino acid sequence of SEQ ID NOs: 18-88, 126, 130, 137, 141, 147, 153, 157, 445, 460, 467, and 482-487.
180. The method of embodiment 170, wherein the guide RNA comprises SEQ ID NO: 222.
181. A method of installing a peptide tag or epitope onto a protein using prime editing, comprising: contacting a target nucleotide sequence encoding the protein with a prime editor construct configured to insert therein a second nucleotide sequence encoding the peptide tag to result in a recombinant nucleotide sequence, such that the peptide tag and the protein are expressed from the recombinant nucleotide sequence as a fusion protein.
182. The method of embodiment 181, wherein the peptide tag is used for purification and/or detection of the protein.
183. The method of embodiment 181, wherein the peptide tag is a poly-histidine (e.g., HHHHHH (SEQ ID NOs: 252-262), FLAG (e.g., DYKDDDDK (SEQ ID NO: 2)), V5 (e.g., GKPIPNPLLGLDST (SEQ ID NO: 3)), GCN4, HA (e.g., YPYDVPDYA (SEQ ID NO: 5)), Myc (e.g. EQKLISEED(SEQ ID NO: 6)), GST . . . etc.
184. The method of embodiment 181, wherein the peptide tag has an amino acid sequence selected from the group consisting of SEQ ID NO: 245-290.
185. The method of embodiment 181, wherein the peptide tag is fused to the protein by a linker.
186. The method of embodiment 181, wherein the fusion protein has the following structure: [protein]-[peptide tag] or [peptide tag]-[protein], wherein "]-[" represents an optional linker.
187. The method of embodiment 181, wherein the linker has an amino acid sequence of SEQ ID NO: 127, 165-176, 446, 453, and 767-769.
188. The method of embodiment 181, wherein the prime editor construct comprises a PEgRNA comprising the nucleotide sequence of SEQ ID NOs: 18-101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-

3121, 3305-3455, 3479-3493, 3522-3540, 3549-3556, 3628-3698, 3755-3810, 3874, 3890-3901, 3905-3911, 3913-3929, 3972-3989.

189. The method of embodiment 181, wherein the PEgRNA comprises a spacer, a gRNA core, and an extension arm, wherein the spacer is complementary to the target nucleotide sequence and the extension arm comprises a reverse transcriptase template that encodes the peptide tag.

190. The method of embodiment 181, wherein the PEgRNA comprises a spacer, a gRNA core, and an extension arm, wherein the spacer is complementary to the target nucleotide sequence and the extension arm comprises a reverse transcriptase template that encodes the peptide tag.

191. A method of preventing or halting the progression of a prion disease by installing on or more protective mutations into PRNP encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the protective mutation; and (c) incorporating the single strand DNA sequence in place of a corresponding endogenous strand at the target nucleotide sequence through a DNA repair and/or replication process, wherein the method produces a recombinant target nucleotide sequence that encodes a PRNP comprising a protective mutation and which is resistant to misfolding.

192. The method of embodiment 191, wherein the prion disease is a human prion disease.

193. The method of embodiment 191, wherein the prion disease is an animal prion disease.

194. The method of embodiment 192, wherein the prion disease is Creutzfeldt-Jakob Disease (CJD), Variant Creutzfeldt-Jakob Disease (vCJD), Gerstmann-Straussler-Scheinker Syndrome, Fatal Familial Insomnia, or Kuru.

195. The method of embodiment 193, wherein the prion disease is Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy.

196. The method of embodiment 191, wherein the wildtype PRNP amino acid sequence is SEQ ID NOs: 291-292.

197. The method of embodiment 191, wherein the method results in a modified PRNP amino acid sequence selected from the group consisting of SEQ ID NOs: 293-323, wherein said modified PRNP protein is resistant to misfolding.

198. The method of embodiment 191, wherein the fusion protein comprises the amino acid sequence of PE1, PE2, or PE3.

199. The method of embodiment 191, wherein the napDNAbp is a Cas9 nickase (nCas9).

200. The method of embodiment 191, wherein the napDNAbp comprises the amino acid sequence of SEQ ID NOs: 18-88, 126, 130, 137, 141, 147, 153, 157, 445, 460, 467, and 482-487.

201. The method of embodiment 191, wherein the guide RNA comprises SEQ ID NO: 222.

202. A method of installing a ribonucleotide motif or tag in an RNA of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the ribonucleotide motif or tag; (b) polymerizing a single strand DNA sequence encoding the ribonucleotide motif or tag; and (c) incorporating the single strand DNA sequence in place of a corresponding endogenous strand at the target nucleotide sequence through a DNA repair and/or replication process, wherein the method produces a recombinant target nucleotide sequence that encodes a modified RNA of interest comprising the ribonucleotide motif or tag.

203. The method of embodiment 202, wherein ribonucleotide motif or tag is a detection moiety.

204. The method of embodiment 202, wherein the ribonucleotide motif or tag affects the expression level of the RNA of interest.

205. The method of embodiment 202, wherein the ribonucleotide motif or tag affects the transport or subcellular location of the RNA of interest.

206. The method of embodiment 202, wherein the ribonucleotide motif or tag is selected from the group consisting of SV40 type 1, SV40 type 2, SV40 type 3, hGH, BGH, rbGlob, TK, MALAT1 ENE-mascRNA, KSHV PAN ENE, Smbox/U1 snRNA box, U1 snRNA 3' box, tRNA-lysine, broccoli aptamer, spinach aptamer, mango aptamer, HDV ribozyme, and m6A.

207. The method of embodiment 202, wherein the PEgRNA comprises SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

208. The method of embodiment 202, wherein the fusion protein comprises the amino acid sequence of PE1, PE2, or PE3.

209. The method of embodiment 202, wherein the napDNAbp is a Cas9 nickase (nCas9).

210. The method of embodiment 202, wherein the napDNAbp comprises the amino acid sequence of SEQ ID NOs: 18-88, 126, 130, 137, 141, 147, 153, 157, 445, 460, 467, and 482-487.

211. A method of installing or deleting a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety or deletion of same; (b) polymerizing a single strand DNA sequence encoding the functional moiety or deletion of same; and (c) incorporating the single strand DNA sequence in place of a corresponding endogenous strand at the target nucleotide sequence through a DNA repair and/or replication process, wherein the method produces a recombinant target nucleotide sequence that encodes a modified protein comprising the protein of interest and the functional moiety or the removal of same, wherein the functional moiety alters a modification state or localization state of the protein.

212. The method of embodiment 211, wherein functional moiety alters the phosphorylation, ubiquitylation, glycosylation, lipidation, hydroxylation, methylation, acetylation, crotonylation, SUMOylation state of the protein of interest.

929

Group 2. Embodiments 213-424

213. A fusion protein comprising a nucleic acid programmable DNA binding protein (napDNAbp) and a polymerase.
214. The fusion protein of embodiment 213, wherein the fusion protein is capable of carrying out prime editing in the presence of an prime editing guide RNA (PEgRNA).
215. The fusion protein of embodiment 213, wherein the napDNAbp has a nickase activity.
216. The fusion protein of embodiment 213, wherein the napDNAbp is a Cas9 protein or variant thereof.
217. The fusion protein of embodiment 213, wherein the napDNAbp is a nuclease active Cas9, a nuclease inactive Cas9 (dCas9), or a Cas9 nickase (nCas9).
218. The fusion protein of embodiment 213, wherein the napDNAbp is Cas9 nickase (nCas9).
219. The fusion protein of embodiment 213, wherein the napDNAbp is selected from the group consisting of: Cas9, Cas12e, Cas12d, Cas12a, Cas12b1, Cas13a, Cas12c, and Argonaute and optionally has a nickase activity.
220. The fusion protein of embodiment 213, wherein the fusion protein when complexed with a PEgRNA is capable of binding to a target DNA sequence.
221. The fusion protein of embodiment 220, wherein the target DNA sequence comprises a target strand and a complementary non-target strand.
222. The fusion protein of embodiment 220, wherein the binding of the fusion protein complexed to the PEgRNA forms an R-loop.
223. The fusion protein of embodiment 222, wherein the R-loop comprises (i) an RNA-DNA hybrid comprising the PEgRNA and the target strand, and (ii) the complementary non-target strand.
224. The fusion protein of embodiment 223, wherein the complementary non-target strand is nicked to form a priming sequence having a free 3' end.
225. The fusion protein of embodiment 214, wherein the PEgRNA comprises (a) a guide RNA and (b) an extension arm at the 5' or the 3' end of the guide RNA, or at an intramolecular location in the guide RNA.
226. The fusion protein of embodiment 225, wherein the extension arm comprises (i) a DNA synthesis template sequence comprising a desired nucleotide change, and (ii) a primer binding site.
227. The fusion protein of embodiment 226, wherein the DNA synthesis template sequence encodes a single-strand DNA flap that is complementary to an endogenous DNA sequence adjacent to the nick site, wherein the single-strand DNA flap comprises the desired nucleotide change.
228. The fusion protein of embodiment 225, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.
229. The fusion protein of embodiment 227, wherein the single-strand DNA flap hybridizes to the endogenous DNA sequence adjacent to the nick site, thereby installing the desired nucleotide change.

930

230. The fusion protein of embodiment 227, wherein the single-stranded DNA flap displaces the endogenous DNA sequence adjacent to the nick site and which has a free 5' end.
231. The fusion protein of embodiment 230, wherein the endogenous DNA sequence having the 5' end is excised by the cell.
232. The fusion protein of embodiment 230, wherein cellular repair of the single-strand DNA flap results in installation of the desired nucleotide change, thereby forming a desired product.
233. The fusion protein of embodiment 226, wherein the desired nucleotide change is installed in an editing window that is between about −4 to +10 of the PAM sequence, or between about −10 to +20 of the PAM sequence, or between about −20 to +40 of the PAM sequence, or between about −30 to +100 of the PAM sequence, or wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.
234. The fusion protein of embodiment 213, wherein the napDNAbp comprises an amino acid sequence of SEQ ID NO: 18, or an amino acid sequence having at least 80%, 85%, 90%, 95%, 98%, or 99% sequence identity with the amino acid sequence to SEQ ID NO: 18.
235. The fusion protein of embodiment 213, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.
236. The fusion protein of embodiment 213, wherein the polymerase is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.
237. The fusion protein of embodiment 213, wherein the polymerase is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.
238. The fusion protein of embodiment 213, wherein the polymerase is a naturally-occurring reverse transcriptase from a retrovirus or a retrotransposon.
239. The fusion protein of any one of the previous embodiments, wherein the fusion protein comprises the structure NH$_2$-[napDNAbp]-[polymerase]-COOH; or NH$_2$-[polymerase]-[napDNAbp]-COOH, wherein each instance of "]-[" indicates the presence of an optional linker sequence.
240. The fusion protein of embodiment 239, wherein the linker sequence comprises an amino acid sequence of SEQ ID NOs: 127, 165-176, 446, 453, and 767-769.
241. The fusion protein of embodiment 226, wherein the desired nucleotide change is a single nucleotide change, an insertion of one or more nucleotides, or a deletion of one or more nucleotides.
242. The fusion protein of embodiment 241, wherein the insert or deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, or at least 50.

243. A PEgRNA comprising a guide RNA and at least one nucleic acid extension arm comprising a DNA synthesis template.

244. The PEgRNA of embodiment 241, wherein the nucleic acid extension arm is position at the 3' or 5' end of the guide RNA, or at an intramolecular position in the guide RNA, and wherein the nucleic acid extension arm is DNA or RNA.

245. The PEgRNA of embodiment 242, wherein the PEgRNA is capable of binding to a napDNAbp and directing the napDNAbp to a target DNA sequence.

246. The PEgRNA of embodiment 245, wherein the target DNA sequence comprises a target strand and a complementary non-target strand, wherein the guide RNA hybridizes to the target strand to form an RNA-DNA hybrid and an R-loop.

247. The PEgRNA of embodiment 243, wherein the at least one nucleic acid extension arm comprises (i) a DNA synthesis template, and (ii) a primer binding site.

248. The PEgRNA of embodiment 247, wherein the nucleic acid extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

249. The PEgRNA of embodiment 247, wherein the DNA synthesis template is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

250. The PEgRNA of embodiment 247, wherein the primer binding site is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

251. The PEgRNA of embodiment 243, further comprising at least one additional structure selected from the group consisting of a linker, a stem loop, a hairpin, a toeloop, an aptamer, or an RNA-protein recruitment domain.

252. The PEgRNA of embodiment 247, wherein the DNA synthesis template encodes a single-strand DNA flap that is complementary to an endogenous DNA sequence adjacent to a nick site, wherein the single-strand DNA flap comprises a desired nucleotide change.

253. The PEgRNA of embodiment 252, wherein the single-stranded DNA flap displaces an endogenous single-strand DNA having a 5' end in the target DNA sequence that has been nicked, and wherein the endogenous single-strand DNA is immediately adjacent downstream of the nick site.

254. The PEgRNA of embodiment 253, wherein the endogenous single-stranded DNA having the free 5' end is excised by the cell.

255. The PEgRNA of embodiment 253, wherein cellular repair of the single-strand DNA flap results in installation of the desired nucleotide change, thereby forming a desired product.

256. The PEgRNA of embodiment 243, comprising the nucleotide sequence of SEQ ID NOs: 18-36, or a nucleotide sequence having at least 85%, or at least 90%, or at least 95%, or at least 98%, or at least 99% sequence identity with any one of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

257. The PEgRNA of embodiment 247, wherein the DNA synthesis template comprises a nucleotide sequence that is at least 80%, or 85%, or 90%, or 95%, or 99% identical to the endogenous DNA target.

258. The PEgRNA of embodiment 247, wherein the primer binding site hybridizes with a free 3' end of the cut DNA.

259. The PEgRNA of embodiment 251, wherein the at least one additional structure is located at the 3' or 5' end of the PEgRNA.

260. A complex comprising comprising a fusion protein of any one of embodiments 213-242 and an PEgRNA.

261. The complex of embodiment 260, wherein the PEgRNA comprises a guide RNA and an nucleic acid extension arm at the 3' or 5' end of the guide RNA or at an intramolecular position in the guide RNA.

262. The complex of embodiment 260, wherein the PEgRNA is capable of binding to a napDNAbp and directing the napDNAbp to a target DNA sequence.

263. The complex of embodiment 262, wherein the target DNA sequence comprises a target strand and a complementary non-target strand, wherein the guide RNA hybridizes to the target strand to form an RNA-DNA hybrid and an R-loop.

264. The complex of embodiment 261, wherein the at least one nucleic acid extension arm comprises (i) a DNA synthesis template, and (ii) a primer binding site.

265. The complex of embodiment 260, wherein the PEgRNA comprises the nucleotide sequence of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989, or a nucleotide sequence having at least 85%, or at least 90%, or at least 95%, or at least 98%, or at least 99% sequence identity with any one of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

266. The complex of embodiment 264, wherein the DNA synthesis template comprises a nucleotide sequence that is at least 80%, or 85%, or 90%, or 95%, or 99% identical to the endogenous DNA target.

267. The complex of embodiment 264, wherein the primer binding site hybridizes with a free 3' end of the cut DNA.

268. A complex comprising comprising a napDNAbp and an PEgRNA.

269. The complex of embodiment 268, wherein the napDNAbp is a Cas9 nickase.

270. The complex of embodiment 268, wherein the napDNAbp comprises an amino acid sequence of SEQ ID NO: 18.

271. The complex of embodiment 268, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

272. The complex of embodiment 268, wherein the PEgRNA comprises a guide RNA and a nucleic acid extension arm at the 3' or 5' end of the guide RNA, or at an intramolecular position in the guide RNA.

273. The complex of embodiment 268, wherein the PEgRNA is capable of directing the napDNAbp to a target DNA sequence.

274. The complex of embodiment 272, wherein the target DNA sequence comprises a target strand and a complementary non-target strand, wherein the spacer sequence of the PEgRNA hybridizes to the target strand to form an RNA-DNA hybrid and an R-loop.

275. The complex of embodiment 273, wherein the nucleic acid extension arm comprises (i) a DNA synthesis template, and (ii) a primer binding site.

276. The complex of embodiment 269, wherein the PEgRNA comprises the nucleotide sequence of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989, or a nucleotide sequence having at least 85%, or at least 90%, or at least 95%, or at least 98%, or at least 99% sequence identity with any one of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

277. The complex of embodiment 276, wherein the DNA synthesis template comprises a nucleotide sequence that is at least 80%, or 85%, or 90%, or 95%, or 99% identical to the endogenous DNA target.

278. The complex of embodiment 276, wherein the primer binding site hybridizes with a free 3' end of the cut DNA.

279. The complex of embodiment 276, wherein the PEgRNA further comprises at least one additional structure selected from the group consisting of a linker, a stem loop, a hairpin, a toeloop, an aptamer, or an RNA-protein recruitment domain.

280. A polynucleotide encoding the fusion protein of any of embodiments 213-242.

281. A vector comprising the polynucleotide of embodiment 280.

282. A cell comprising the fusion protein of any of embodiments 213-242 and an PEgRNA bound to the napDNAbp of the fusion protein.

283. A cell comprising a complex of any one of embodiments 260-279.

284. A pharmaceutical composition comprising: (i) a fusion protein of any of embodiments 213-242, the complex of embodiments 260-279, the polynucleotide of embodiment 68, or the vector of embodiment 69; and (ii) a pharmaceutically acceptable excipient.

285. A pharmaceutical composition comprising: (i) the complex of embodiments 260-279 (ii) a polymerase provided in trans; and (iii) a pharmaceutically acceptable excipient.

286. A kit comprising a nucleic acid construct, comprising: (i) a nuleic acid sequencing encoding the fusion protein of any one of embodiments 213-242; and (ii) a promoter that drives expression of the sequence of (i).

287. A method for installing a desired nucleotide change in a double-stranded DNA sequence, the method comprising:
(i) contacting the double-stranded DNA sequence with a complex comprising a fusion protein and a PEgRNA, wherein the fusion protein comprises a napDNAbp and a polymerase and wherein the PEgRNA comprises a DNA synthesis template comprising the desired nucleotide change and a primer binding site;
(ii) nicking the double-stranded DNA sequence, thereby generating a free single-strand DNA having a 3' end;
(iii) hybridizing the 3' end of the free single-strand DNA to the primer binding site, thereby priming the polymerase;
(iv) polymerizing a strand of DNA from the 3' end hybridized to the primer binding site, thereby generating a single-strand DNA flap comprising the desired nucleotide change and which is complementary to the DNA synthesis template;
(v) replacing an endogenous DNA strand adjacent the cut site with the single-strand DNA flap, thereby installing the desired nucleotide change in the double-stranded DNA sequence.

288. The method of embodiment 287, wherein the step of (v) replacing comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

289. The method of embodiment 288, wherein the desired nucleotide change is a single nucleotide substitution, a deletion, or an insertion.

290. The method of embodiment 289, wherein the single nucleotide substitution is a transition or a transversion.

291. The method of embodiment 288, wherein the desired nucleotide change is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

292. The method of embodiment 288, wherein the desired nucleoid change converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, a C:G basepair to an A:T basepair, (10) an A:T basepair to a T:A basepair, (11) an A:T basepair to a G:C basepair, or (12) an A:T basepair to a C:G basepair.

293. The method of embodiment 288, wherein the desired nucleotide change is an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

294. The method of embodiment 288, wherein the desired nucleotide change corrects a disease-associated gene.

295. The method of embodiment 294, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

296. The method of embodiment 294, wherein the disease-associated gene is associated with a polygenic disorder selected from the group consisting of: heart disease; high blood pressure; Alzheimer's disease; arthritis; diabetes; cancer; and obesity.

297. The method of embodiment 287, wherein the napDNAbp is a nuclease dead Cas9 (dCas9), a Cas9 nickase (nCas9), or a nuclease active Cas9.

298. The method of embodiment 287, wherein the napDNAbp comprises an amino acid sequence of SEQ ID NO: 18, or an amino acid sequence having at least 80%, 85%, 90%, 95%, 98%, or 99% sequence identity with the amino acid sequence of SEQ ID NO: 18.

299. The method of embodiment 287, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

300. The method of embodiment 287, wherein the polymerase is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

301. The method of embodiment 287, wherein the polymerase is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

302. The method of embodiment 287, wherein the PEgRNA comprises a nucleic acid extension arm at the 3' or 5' ends or at an intramolecular location in the guide RNA, wherein the extension arm comprises the DNA synthesis template sequence and the primer binding site.

303. The method of embodiment 302, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

304. The method of embodiment 287, wherein the PEgRNA has a nucleotide sequence selected from the group consisting of SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

305. A method for introducing one or more changes in the nucleotide sequence of a DNA molecule at a target locus, comprising:
(i) contacting the DNA molecule with a nucleic acid programmable DNA binding protein (napDNAbp) and a PEgRNA which targets the napDNAbp to the target locus, wherein the PEgRNA comprises a reverse transcriptase (RT) template sequence comprising at least one desired nucleotide change and a primer binding site;
(ii) forming an exposed 3' end in a DNA strand at the target locus;
(iii) hybridizing the exposed 3' end to the primer binding site to prime reverse transcription;
(iv) synthesizing a single strand DNA flap comprising the at least one desired nucleotide change based on the RT template sequence by reverse transcriptase;
(v) and incorporating the at least one desired nucleotide change into the corresponding endogenous DNA, thereby introducing one or more changes in the nucleotide sequence of the DNA molecule at the target locus.

306. The method of embodiment 305, wherein the one or more changes in the nucleotide sequence comprises a transition.

307. The method of embodiment 306, wherein the transition is selected from the group consisting of: (a) T to C; (b) A to G; (c) C to T; and (d) G to A.

308. The method of embodiment 305, wherein the one or more changes in the nucleotide sequence comprises a transversion.

309. The method of embodiment 308, wherein the transversion is selected from the group consisting of: (a) T to A; (b) T to G; (c) C to G; (d) C to A; (e) A to T; (f) A to C; (g) G to C; and (h) G to T.

310. The method of embodiment 305, wherein the one or more changes in the nucleotide sequence comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (9) an A:T basepair to a T:A basepair, (11) an A:T basepair to a G:C basepair, or (12) an A:T basepair to a C:G basepair.

311. The method of embodiment 305, wherein the one or more changes in the nucleotide sequence comprises an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

312. The method of embodiment 305, wherein the one or more changes in the nucleotide sequence comprises a correction to a disease-associated gene.

313. The method of embodiment 312, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

314. The method of embodiment 312, wherein the disease-associated gene is associated with a polygenic disorder selected from the group consisting of: heart disease; high blood pressure; Alzheimer's disease; arthritis; diabetes; cancer; and obesity.

315. The method of embodiment 305, wherein the napDNAbp is a nuclease active Cas9 or variant thereof.

316. The method of embodiment 305, wherein the napDNAbp is a nuclease inactive Cas9 (dCas9) or Cas9 nickase (nCas9), or a variant thereof.

317. The method of embodiment 305, wherein the napDNAbp comprises an amino acid sequence of SEQ ID NO: 18, or an amino acid sequence having at least 80%, 85%, 90%, 95%, 98%, or 99% sequence identity with SEQ ID NO: 18.

318. The method of embodiment 305, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

319. The method of embodiment 305, wherein the reverse transcriptase is introduced in trans.

320. The method of embodiment 305, wherein the napDNAbp comprises a fusion to a reverse transcriptase.

321. The method of embodiment 305, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

322. The method of embodiment 305, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

323. The method of embodiment 305, wherein the step of forming an exposed 3' end in the DNA strand at the target locus comprises nicking the DNA strand with a nuclease.

324. The method of embodiment 323, wherein the nuclease is provided is provided in trans.

325. The method of embodiment 305, wherein the step of forming an exposed 3' end in the DNA strand at the target locus comprises contacting the DNA strand with a chemical agent.

326. The method of embodiment 305, wherein the step of forming an exposed 3' end in the DNA strand at the target locus comprises introducing a replication error.

327. The method of embodiment 305, wherein the step of contacting the DNA molecule with the napDNAbp and the guide RNA forms an R-loop.

328. The method of embodiment 327, wherein the DNA strand in which the exposed 3' end is formed is in the R-loop.

329. The method of embodiment 315, wherein the PEgRNA comprises an extension arm that comprises the reverse transcriptase (RT) template sequence and the primer binding site.

330. The method of embodiment 329, wherein the extension arm is at the 3' end of the guide RNA, the 5' end of the guide RNA, or at an intramolecular position in the guide RNA.

331. The method of embodiment 305, wherein the PEgRNA further comprises at least one additional structure selected from the group consisting of a linker, a stem loop, a hairpin, a toeloop, an aptamer, or an RNA-protein recruitment domain.

332. The method of embodiment 305, wherein the PEgRNA further comprises a homology arm.

333. The method of embodiment 305, wherein the RT template sequence is homologous to the corresponding endogenous DNA.

334. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change; (b) conducting target-primed reverse transcription of the RT template to generate a single strand DNA comprising the desired nucleotide change; and (c) incorporating the desired nucleotide change into the DNA molecule at the target locus through a DNA repair and/or replication process.

335. The method of embodiment 334, wherein the RT template is located at the 3' end of the guide RNA, the 5' end of the guide RNA, or at an intramolecular location in the guide RNA.

336. The method of embodiment 334, wherein the desired nucleotide change comprises a transition, a transversion, an insertion, or a deletion, or any combination thereof.

337. The method of embodiment 334, wherein the desired nucleotide change comprises a transition selected from the group consisting of: (a) T to C; (b) A to G; (c) C to T; and (d) G to A.

338. The method of claim 334, wherein the desired nucleotide change comprises a transversion selected from the group consisting of: (a) T to A; (b) T to G; (c) C to G; (d) C to A; (e) A to T; (f) A to C; (g) G to C; and (h) G to T.

339. The method of embodiment 334, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

340. A polynucleotide encoding the PEgRNA of any one of embodiments 243-259.

341. A vector comprising the polynucleotide of embodiment 340.

342. A cell comprising the vector of embodiment 341.

343. The fusion protein of embodiment 213, wherein the polymerase is an error-prone reverse transcriptase.

344. A method for mutagenizing a DNA molecule at a target locus by target-primed reverse transcription, the method comprising: (a) contacting the DNA molecule at the target locus with a (i) fusion protein comprising a nucleic acid programmable DNA binding protein (napDNAbp) and an error-prone reverse transcriptase and (ii) a guide RNA comprising an RT template comprising a desired nucleotide change; (b) conducting target-primed reverse transcription of the RT template to generate a mutagenized single strand DNA; and (c) incorporating the mutagenized single strand DNA into the DNA molecule at the target locus through a DNA repair and/or replication process.

345. The method of any prior embodiment, wherein the fusion protein comprises the amino acid sequence of PE1, PE2, or PE3.

346. The method of any prior embodiment, wherein the napDNAbp is a Cas9 nickase (nCas9).

347. The method of embodiment 344, wherein the napDNAbp comprises the amino acid sequence of SEQ ID NOs: 18-88, 126, 130, 137, 141, 147, 153, 157, 445, 460, 467, and 482-487.

348. The method of embodiment 344, wherein the guide RNA comprises SEQ ID NO: 222.

349. The method of embodiment 344, wherein the step of (b) conducting target-primed reverse transcription comprises generating a 3' end primer binding sequence at the target locus that is capable of priming reverse transcription by annealing to a primer binding site on the guide RNA.

350. A method for replacing a trinucleotide repeat expansion mutation in a target DNA molecule with a healthy sequence comprising a healthy number of repeat trinucleotides, the method comprising: (a) contacting the DNA molecule at the target locus with a (i) fusion protein comprising a nucleic acid programmable DNA binding protein (napDNAbp) and a polymerase and (ii) a PEgRNA comprising DNA synthesis template comprising the replacement sequence and a primer binding site; (b) conducting prime editing to generate a single strand DNA comprising the replacement sequence; and (c) incorporating the single strand DNA into the DNA molecule at the target locus through a DNA repair and/or replication process.

351. The method of embodiment 350, wherein the fusion protein comprises the amino acid sequence of PE1, PE2, or PE3.

352. The method of embodiment 350, wherein the napDNAbp is a Cas9 nickase (nCas9).

353. The method of embodiment 350, wherein the napDNAbp comprises the amino acid sequence of SEQ ID NOs: 18-88, 126, 130, 137, 141, 147, 153, 157, 445, 460, 467, and 482-487.

354. The method of embodiment 350, wherein the guide RNA comprises SEQ ID NO: 222.

355. The method of embodiment 350, wherein the step of (b) conducting prime editing comprises generating a 3' end primer binding sequence at the target locus that is capable of priming polymerase by annealing to the primer binding site on the guide RNA.

356. The method of embodiment 350, wherein the trinucleotide repeat expansion mutation is associated with Huntington's Disease, Fragile X syndrome, or Friedreich's ataxia.

357. The method of embodiment 350, wherein the trinucleotide repeat expansion mutation comprises a repeating unit of CAG triplets.

358. The method of embodiment 350, wherein the trinucleotide repeat expansion mutation comprises a repeating unit of GAA triplets.

359. A method of installing a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising DNA synthesis template encoding the functional moiety; (b) polymerizing a single strand DNA sequence encoding the functional moiety; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the functional moiety.

360. The method of embodiment 359, wherein functional moiety is peptide tag.

361. The method of embodiment 360, wherein the peptide tag is an affinity tag, solubilization tag, chromatography tag, epitope or immunoepitope tag, or a fluorescence tag.

362. The method of embodiment 360, wherein the peptide tag is selected from the group consisting of: AviTag (SEQ ID NO: 245); C-tag (SEQ ID NO: 246); Calmodulin-tag (SEQ ID NO: 247); polyglutamate tag (SEQ ID NO: 248); E-tag (SEQ ID NO: 249); FLAG-tag (SEQ ID NO: 250); HA-tag (SEQ ID NO: 251); His-tag (SEQ ID NOs: 252-262); Myc-tag (SEQ ID NO: 263); NE-tag (SEQ ID NO: 264); Rho1D4-tag (SEQ ID NO: 265); S-tag (SEQ ID NO: 266); SBP-tag (SEQ ID NO: 267); Softag-1 (SEQ ID NO: 268); Softag-2 (SEQ ID NO: 269); Spot-tag (SEQ ID NO: 270); Strep-tag (SEQ ID NO: 271); TC tag (SEQ ID NO: 272); Ty tag (SEQ ID NO: 273); V5 tag (SEQ ID NO: 274); VSV-tag (SEQ ID NO: 275); and Xpress tag (SEQ ID NO: 276).

363. The method of embodiment 360, wherein the peptide tag is selected from the group consisting of: AU1 epitope (SEQ ID NO: 278); AU5 epitope (SEQ ID NO: 279); Bacteriophage T7 epitope (T7-tag) (SEQ ID NO: 280); Bluetongue virus tag (B-tag) (SEQ ID NO: 281); E2 epitope (SEQ ID NO: 282); Histidine affinity tag (HAT) (SEQ ID NO: 283); HSV epitope (SEQ ID NO: 284); Polyarginine (Arg-tag) (SEQ ID NO: 285); Polyaspartate (Asp-tag) (SEQ ID NO: 286); Polyphenylalanine (Phe-tag) (SEQ ID NO: 287); 51-tag (SEQ ID NO: 288); S-tag (SEQ ID NO: 289); and VSV-G (SEQ ID NO: 290).

364. The method of embodiment 359, wherein the functional moiety is an immunoepitope.

365. The method of embodiment 364, wherein the immunoepitope is selected from the group consisting of: tetanus toxoid (SEQ ID NO: 396); diphtheria toxin mutant CRM197 (SEQ ID NO: 398); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

366. The method of embodiment 359, wherein the functional moiety alters the localization of the protein of interest.

367. The method of embodiment 359, wherein the functional moiety is a degradation tag such that the degradation rate of the protein of interest is altered.

368. The method of embodiment 367, wherein the degradation tag results in the elimination of the tagged protein.
369. The method of embodiment 359, wherein the functional moiety is a small molecule binding domain.
370. The method of embodiment 359, wherein the small molecule binding domain is FKBP12 of SEQ ID NO: 488.
371. The method of embodiment 359, wherein the small molecule binding domain is FKBP12-F36V of SEQ ID NO: 489.
372. The method of embodiment 359, wherein the small molecule binding domain is cyclophilin of SEQ ID NOs: 490 and 493-494.
373. The method of embodiment 359, wherein the small molecule binding domain is installed in two or more proteins of interest.
374. The method of embodiment 373, wherein the two or more proteins of interest may dimerize upon contacting with a small molecule.
375. The method of embodiment 369, wherein the small molecule is a dimer of a small molecule selected from the group consisting of:

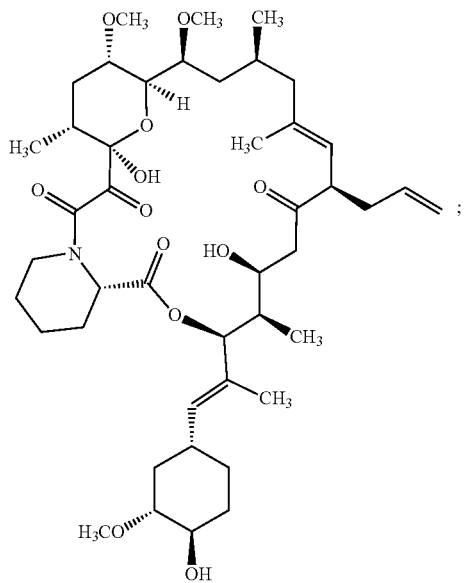

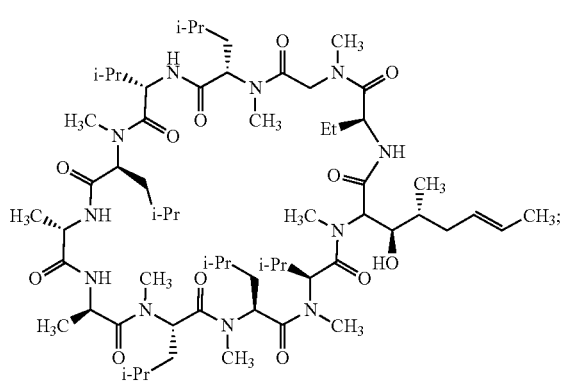

-continued

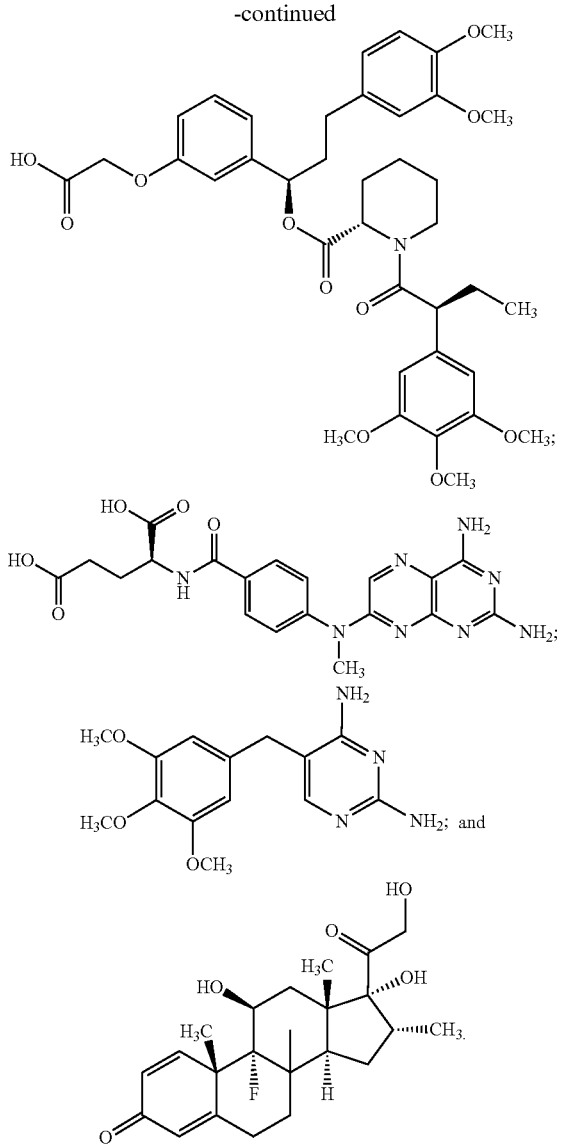

376. A method of installing an immunoepitope in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the immunoepitope.

377. The method of embodiment 376, wherein the immunoepitope is selected from the group consisting of: tetanus toxoid (SEQ ID NO: 396); diphtheria toxin mutant CRM197 (SEQ ID NO: 398); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

378. The method of embodiment 376, wherein the fusion protein comprises the amino acid sequence of PE1, PE2, or PE3.

379. The method of embodiment 376, wherein the napD-NAbp is a Cas9 nickase (nCas9).

380. The method of embodiment 376, wherein the napD-NAbp comprises the amino acid sequence of SEQ ID NOs: 18-88, 126, 130, 137, 141, 147, 153, 157, 445, 460, 467, and 482-487.

381. The method of embodiment 376, wherein the PEgRNA comprises SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

382. A method of installing a small molecule dimerization domain in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the small molecule dimerization domain; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the small molecule dimerization domain.

383. The method of embodiment 382, further comprising conducting the method on a second protein of interest.

384. The method of embodiment 383, wherein the first protein of interest and the second protein of interest dimerize in the presence of a small molecule that binds to the dimerization domain on each of said proteins.

385. The method of embodiment 382, wherein the small molecule binding domain is FKBP12 of SEQ ID NO: 488.

386. The method of embodiment 382, wherein the small molecule binding domain is FKBP12-F36V of SEQ ID NO: 489.

387. The method of embodiment 382, wherein the small molecule binding domain is cyclophilin of SEQ ID NOs: 490 and 493-494.

388. The method of embodiment 382, wherein the small molecule is a dimer of a small molecule selected from the group consisting of:

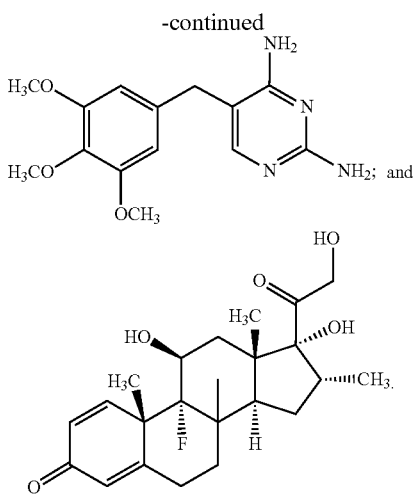

389. The method of embodiment 382, wherein the fusion protein comprises the amino acid sequence of PE1, PE2, or PE3.
390. The method of embodiment 382, wherein the napD-NAbp is a Cas9 nickase (nCas9).
391. The method of embodiment 382, wherein the napD-NAbp comprises the amino acid sequence of SEQ ID NOs: 18-88, 126, 130, 137, 141, 147, 153, 157, 445, 460, 467, and 482-487.
392. The method of embodiment 382, wherein the PEgRNA comprises SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.
393. A method of installing a peptide tag or epitope onto a protein using prime editing, comprising: contacting a target nucleotide sequence encoding the protein with a prime editor construct configured to insert therein a second nucleotide sequence encoding the peptide tag to result in a recombinant nucleotide sequence, such that the peptide tag and the protein are expressed from the recombinant nucleotide sequence as a fusion protein.
394. The method of embodiment 383, wherein the peptide tag is used for purification and/or detection of the protein.
395. The method of embodiment 383, wherein the peptide tag is a poly-histidine (e.g., HHHHHH (SEQ ID NO: 252-262)), FLAG (e.g., DYKDDDDK (SEQ ID NO: 2)), V5 (e.g., GKPIPNPLLGLDST (SEQ ID NO: 3)), GCN4, HA (e.g., YPYDVPDYA (SEQ ID NO: 5)), Myc (e.g. EQKLISEED (SEQ ID NO: 6)), or GST.
396. The method of embodiment 383, wherein the peptide tag has an amino acid sequence selected from the group consisting of SEQ ID NO: 245-290.
397. The method of embodiment 383, wherein the peptide tag is fused to the protein by a linker.
398. The method of embodiment 383, wherein the fusion protein has the following structure: [protein]-[peptide tag] or [peptide tag]-[protein], wherein "]-[" represents an optional linker.
399. The method of embodiment 383, wherein the linker has an amino acid sequence of SEQ ID NOs: 127, 165-176, 446, 453, and 767-769.
400. The method of embodiment 383, wherein the prime editor construct comprises a PEgRNA comprising the nucleotide sequence of SEQ ID NOs: 18-101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.
401. The method of embodiment 383, wherein the PEgRNA comprises a spacer, a gRNA core, and an extension arm, wherein the spacer is complementary to the target nucleotide sequence and the extension arm comprises a reverse transcriptase template that encodes the peptide tag.
402. The method of embodiment 383, wherein the PEgRNA comprises a spacer, a gRNA core, and an extension arm, wherein the spacer is complementary to the target nucleotide sequence and the extension arm comprises a reverse transcriptase template that encodes the peptide tag.
403. A method of preventing or halting the progression of a prion disease by installing on or more protective mutations into PRNP encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety; (b) polymerizing a single strand DNA sequence encoding the protective mutation; and (c) incorporating the single strand DNA sequence in place of a corresponding endogenous strand at the target nucleotide sequence through a DNA repair and/or replication process, wherein the method produces a recombinant target nucleotide sequence that encodes a PRNP comprising a protective mutation and which is resistant to misfolding.
404. The method of embodiment 403, wherein the prion disease is a human prion disease.
405. The method of embodiment 403, wherein the prion disease is an animal prion disease.
406. The method of embodiment 404, wherein the prion disease is Creutzfeldt-Jakob Disease (CJD), Variant Creutzfeldt-Jakob Disease (vCJD), Gerstmann-Straussler-Scheinker Syndrome, Fatal Familial Insomnia, or Kuru.
407. The method of embodiment 403, wherein the prion disease is Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy.
408. The method of embodiment 403, wherein the wildtype PRNP amino acid sequence is SEQ ID NOs: 291-292.
409. The method of embodiment 403, wherein the method results in a modified PRNP amino acid sequence selected from the group consisting of SEQ ID NOs: 293-323, wherein said modified PRNP protein is resistant to misfolding.
410. The method of embodiment 403, wherein the fusion protein comprises the amino acid sequence of PE1, PE2, or PE3.
411. The method of embodiment 403, wherein the napD-NAbp is a Cas9 nickase (nCas9).
412. The method of embodiment 403, wherein the napD-NAbp comprises the amino acid sequence of SEQ ID NOs:18-88, 126, 130, 137, 141, 147, 153, 157, 445, 460, 467, and 482-487.

413. The method of embodiment 403, wherein the PEgRNA comprises SEQ ID NOs: 101-104, 181-183, 223-234, 237-244, 277, 324-330, 332, 334, 336, 338, 340, 342, 344, 346, 348, 350, 352, 354, 356, 358, 360, 362, 364, 366, 368, 394, 429-442, 499-505, 641-649, 678-692, 735-736, 757-761, 776-777, 2997-3103, 3113-3121, 3305-3455, 3479-3493, 3522-3540, 3549-3556, 3628-3698, 3755-3810, 3874, 3890-3901, 3905-3911, 3913-3929, 3972-3989.

414. A method of installing a ribonucleotide motif or tag in an RNA of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the ribonucleotide motif or tag; (b) polymerizing a single strand DNA sequence encoding the ribonucleotide motif or tag; and (c) incorporating the single strand DNA sequence in place of a corresponding endogenous strand at the target nucleotide sequence through a DNA repair and/or replication process, wherein the method produces a recombinant target nucleotide sequence that encodes a modified RNA of interest comprising the ribonucleotide motif or tag.

415. The method of embodiment 414, wherein ribonucleotide motif or tag is a detection moiety.

416. The method of embodiment 414, wherein the ribonucleotide motif or tag affects the expression level of the RNA of interest.

417. The method of embodiment 414, wherein the ribonucleotide motif or tag affects the transport or subcellular location of the RNA of interest.

418. The method of embodiment 414, wherein the ribonucleotide motif or tag is selected from the group consisting of SV40 type 1, SV40 type 2, SV40 type 3, hGH, BGH, rbGlob, TK, MALAT1 ENE-mascRNA, KSHV PAN ENE, Smbox/U1 snRNA box, U1 snRNA 3' box, tRNA-lysine, broccoli aptamer, spinach aptamer, mango aptamer, HDV ribozyme, and m6A.

419. The method of embodiment 414, wherein the PEgRNA comprises SEQ ID NOs: 18-88, 126, 130, 137, 141, 147, 153, 157, 445, 460, 467, and 482-487.

420. The method of embodiment 414, wherein the fusion protein comprises the amino acid sequence of PE1, PE2, or PE3.

421. The method of embodiment 414, wherein the napDNAbp is a Cas9 nickase (nCas9).

422. The method of embodiment 414, wherein the napDNAbp comprises the amino acid sequence of SEQ ID NOs: 18-88, 126, 130, 137, 141, 147, 153, 157, 445, 460, 467, and 482-487.

423. A method of installing or deleting a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety or deletion of same; (b) polymerizing a single strand DNA sequence encoding the functional moiety or deletion of same; and (c) incorporating the single strand DNA sequence in place of a corresponding endogenous strand at the target nucleotide sequence through a DNA repair and/or replication process, wherein the method produces a recombinant target nucleotide sequence that encodes a modified protein comprising the protein of interest and the functional moiety or the removal of same, wherein the functional moiety alters a modification state or localization state of the protein.

424. The method of embodiment 423, wherein functional moiety alters the phosphorylation, ubiquitylation, glycosylation, lipidation, hydroxylation, methylation, acetylation, crotonylation, SUMOylation state of the protein of interest.

Group A. Fusion Proteins, Guides, and Methods

Embodiment 1. A fusion protein comprising a nucleic acid programmable DNA binding protein (napDNAbp) and a reverse transcriptase.

Embodiment 2. The fusion protein of embodiment 1, wherein the fusion protein is capable of carrying out genome editing by target-primed reverse transcription in the presence of an extended guide RNA.

Embodiment 3. The fusion protein of embodiment 1, wherein the napDNAbp has a nickase activity.

Embodiment 4. The fusion protein of embodiment 1, wherein the napDNAbp is a Cas9 protein or variant thereof.

Embodiment 5. The fusion protein of embodiment 1, wherein the napDNAbp is a nuclease active Cas9, a nuclease inactive Cas9 (dCas9), or a Cas9 nickase (nCas9).

Embodiment 6. The fusion protein of embodiment 1, wherein the napDNAbp is Cas9 nickase (nCas9).

Embodiment 7. The fusion protein of embodiment 1, wherein the napDNAbp is selected from the group consisting of: Cas9, CasX, CasY, Cpf1, C2c1, C2c2, C2C3, and Argonaute and optionally has a nickase activity.

Embodiment 8. The fusion protein of embodiment 1, wherein the fusion protein when complexed with an extended guide RNA is capable of binding to a target DNA sequence.

Embodiment 9. The fusion protein of embodiment 8, wherein the target DNA sequence comprises a target strand and a complementary non-target strand.

Embodiment 10. The fusion protein of embodiment 8, wherein the binding of the fusion protein complexed to the extended guide RNA forms an R-loop.

Embodiment 11. The fusion protein of embodiment 10, wherein the R-loop comprises (i) an RNA-DNA hybrid comprising the extended guide RNA and the target strand, and (ii) the complementary non-target strand.

Embodiment 12. The fusion protein of embodiment 11, wherein the complementary non-target strand is nicked to form a reverse transcriptase priming sequence having a free 3' end.

Embodiment 13. The fusion protein of embodiment 2, wherein the extended guide RNA comprises (a) a guide RNA, and (b) an RNA extension at the 5' or the 3' end of the guide RNA, or at an intramolecular location in the guide RNA.

Embodiment 14. The fusion protein of embodiment 13, wherein the RNA extension comprises (i) a reverse transcription template sequence comprising a desired nucleotide change, (ii) a reverse transcription primer binding site, and (iii) optionally, a linker sequence.

Embodiment 15. The fusion protein of embodiment 14, wherein the reverse transcription template sequence encodes a single-strand DNA flap that is complementary to an endogenous DNA sequence adjacent to the nick site, wherein the single-strand DNA flap comprises the desired nucleotide change.

Embodiment 16. The fusion protein of embodiment 13, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 17. The fusion protein of embodiment 15, wherein the single-strand DNA flap hybridizes to the endogenous DNA sequence adjacent to the nick site, thereby installing the desired nucleotide change.

Embodiment 18. The fusion protein of embodiment 15, wherein the single-stranded DNA flap displaces the endogenous DNA sequence adjacent to the nick site and which has a free 5' end.

Embodiment 19. The fusion protein of embodiment 18, wherein the endogenous DNA sequence having the 5' end is excised by the cell.

Embodiment 20. The fusion protein of embodiment 18, wherein cellular repair of the single-strand DNA flap results in installation of the desired nucleotide change, thereby forming a desired product.

Embodiment 21. The fusion protein of embodiment 14, wherein the desired nucleotide change is installed in an editing window that is between about −4 to +10 of the PAM sequence, or between about −10 to +20 of the PAM sequence, or between about −20 to +40 of the PAM sequence, or between about −30 to +100 of the PAM sequence, or wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.

Embodiment 22. The fusion protein of embodiment 1, wherein the napDNAbp comprises an amino acid sequence of SEQ ID NO: 18, or an amino acid sequence that is at least 80%, 85%, 90%, 95%, 98%, or 99% identical to the amino acid sequence to SEQ ID NO: 18.

Embodiment 23. The fusion protein of embodiment 1, wherein the napDNAbp comprises an amino acid sequence that is at least 80%, 85%, 90%, 95%, 98%, or 99% identical to the amino acid sequence of any one of SEQ ID NOs: 18-88, 126, 130, 137, 141, 147, 153, 157, 445, 460, 467, and 482-487.

The fusion protein of embodiment 1, wherein the reverse transcriptase comprises any one of the amino acid sequences of SEQ ID NO: 89.

Embodiment 24. The fusion protein of embodiment 1, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

The fusion protein of embodiment 1, wherein the reverse transcriptase comprises an amino acid sequence that is at least 80%, 85%, 90%, 95%, 98%, or 99% identical to the amino acid sequence of any one of SEQ ID NO: 89.

Embodiment 25. The fusion protein of embodiment 1, wherein the reverse transcriptase comprises an amino acid sequence that is at least 80%, 85%, 90%, 95%, 98%, or 99% identical to the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 26. The fusion protein of embodiment 1, wherein the reverse transcriptase is a naturally-occurring reverse transcriptase from a retrovirus or a retrotransposon.

Embodiment 27. The fusion protein of any one of the previous embodiments, wherein the fusion protein comprises the structure NH2-[napDNAbp]-[reverse transcriptase]-COOH; or NH2-[reverse transcriptase]-[napDNAbp]-COOH, wherein each instance of "]-[" indicates the presence of an optional linker sequence.

Embodiment 28. The fusion protein of embodiment 27, wherein the linker sequence comprises an amino acid sequence of SEQ ID NOs: 127, 165-176, 446, 453, and 767-769.

Embodiment 29. The fusion protein of embodiment 14, wherein the desired nucleotide change is a single nucleotide change, an insertion of one or more nucleotides, or a deletion of one or more nucleotides.

Embodiment 30. The fusion protein of embodiment 29, wherein the insert or deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, or at least 50.

Embodiment 31. An extended guide RNA comprising a guide RNA and at least one RNA extension.

Embodiment 32. The extended guide RNA of embodiment 1, wherein the RNA extension is position at the 3' or 5' end of the guide RNA, or at an intramolecular position in the guide RNA.

Embodiment 33. The extended guide RNA of embodiment 31, wherein the extended guide RNA is capable of binding to a napDNAbp and directing the napDNAbp to a target DNA sequence.

Embodiment 34. The extended guide RNA of embodiment 33, wherein the target DNA sequence comprises a target strand and a complementary non-target strand, wherein the guide RNA hybridizes to the target strand to form an RNA-DNA hybrid and an R-loop.

Embodiment 35. The extended guide RNA of embodiment 31, wherein the at least one RNA extension comprises (i) a reverse transcription template sequence, (ii) a reverse transcription primer binding site, and (iii) optionally a linker sequence.

Embodiment 36. The extended guide RNA of embodiment 35, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 37. The extended guide RNA of embodiment 35, wherein the reverse transcription template sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 38. The extended guide RNA of embodiment 35, wherein the reverse transcription primer binding site sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 39. The extended guide RNA of embodiment 35, wherein the optional linker sequence is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 40. The extended guide RNA of embodiment 35, wherein the reverse transcription template sequence encodes a single-strand DNA flap that is complementary to an endogenous DNA sequence adjacent to a nick site, wherein the single-strand DNA flap comprises a desired nucleotide change.

Embodiment 41. The extended guide RNA of embodiment 40, wherein the single-stranded DNA flap displaces an endogenous single-strand DNA having a 5' end in the target DNA sequence that has been nicked, and wherein the endogenous single-strand DNA is immediately adjacent downstream of the nick site.

Embodiment 42. The extended guide RNA of embodiment 41, wherein the endogenous single-stranded DNA having the free 5' end is excised by the cell.

Embodiment 43. The extended guide RNA of embodiment 41, wherein cellular repair of the single-strand DNA flap results in installation of the desired nucleotide change, thereby forming a desired product.

Embodiment 44. The extended guide RNA of embodiment 31, comprising the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

Embodiment 45. The extended guide RNA of embodiment 35, wherein the reverse transcription template sequence comprises a nucleotide sequence that is at least 80%, or 85%, or 90%, or 95%, or 99% identical to the endogenous DNA target.

Embodiment 46. The extended guide RNA of embodiment 35, wherein the reverse transcription primer binding site hybridizes with a free 3' end of the cut DNA.

Embodiment 47. The extended guide RNA of embodiment 35, wherein the optional linker sequence is at least 1 nucleotide, or at least 2, at least 3, at least 4, at least 5, at least 6, at least 7, at least 8, at least 9, at least 10, at least 11, at least 12, at least 13, at least 14, or at least 15 nucleotides in length.

Embodiment 48. A complex comprising comprising a fusion protein of any one of embodiments 1-30 and an extended guide RNA.

Embodiment 49. The complex of embodiment 48, wherein the extended guide RNA comprises a guide RNA and an RNA extension at the 3' or 5' end of the guide RNA or at an intramolecular position in the guide RNA.

Embodiment 50. The complex of embodiment 48, wherein the extended guide RNA is capable of binding to a napDNAbp and directing the napDNAbp to a target DNA sequence.

Embodiment 51. The complex of embodiment 50, wherein the target DNA sequence comprises a target strand and a complementary non-target strand, wherein the guide RNA hybridizes to the target strand to form an RNA-DNA hybrid and an R-loop.

Embodiment 52. The complex of embodiment 49, wherein the at least one RNA extension comprises (i) a reverse transcription template sequence, (ii) a reverse transcription primer binding site, and (iii) optionally a linker sequence.

Embodiment 53. The complex of embodiment 48, wherein the extended guide RNA comprises the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

Embodiment 54. The complex of embodiment 52, wherein the reverse transcription template sequence comprises a nucleotide sequence having at least 80%, or 85%, or 90%, or 95%, or 99% sequence identity with the endogenous DNA target.

Embodiment 55. The complex of embodiment 52, wherein the reverse transcription primer binding site hybridizes with a free 3' end of the cut DNA.

Embodiment 56. A complex comprising comprising a napDNAbp and an extended guide RNA.

Embodiment 57. The complex of embodiment 56, wherein the napDNAbp is a Cas9 nickase.

Embodiment 58. The complex of embodiment 56, wherein the napDNAbp comprises an amino acid sequence of SEQ ID NO: 18, or an amino acid sequence having at least 80%, 85%, 90%, 95%, 98%, or 99% sequence identity with SEQ ID NO: 18.

Embodiment 59. The complex of embodiment 57, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 60. The complex of embodiment 57, wherein the extended guide RNA comprises a guide RNA and an RNA extension at the 3' or 5' end of the guide RNA, or at an intramolecular position in the guide RNA.

Embodiment 61. The complex of embodiment 57, wherein the extended guide RNA is capable of directing the napDNAbp to a target DNA sequence.

Embodiment 62. The complex of embodiment 61, wherein the target DNA sequence comprises a target strand and a complementary non-target strand, wherein the spacer sequence hybridizes to the target strand to form an RNA-DNA hybrid and an R-loop.

Embodiment 63. The complex of embodiment 61, wherein the RNA extension comprises (i) a reverse transcription template sequence, (ii) a reverse transcription primer binding site, and (iii) optionally a linker sequence.

Embodiment 64. The complex of embodiment 57, wherein the extended guide RNA comprises the nucleotide sequence of SEQ ID NOs: 394, 429-442, 641-649, 678-692, 2997-3103, 3113-3121, 3305-3455, 3479-3493, 3522-3556, 3628-3698, and 3755-3810, or a nucleotide sequence having at least 85%, or at least 90%, or at least 95%, or at least 98%, or at least 99% sequence identity with any one of SEQ ID NOs: 394, 429-442, 641-649, 678-692, 2997-3103, 3113-3121, 3305-3455, 3479-3493, 3522-3556, 3628-3698, and 3755-3810.

Embodiment 65. The complex of embodiment 63, wherein the reverse transcription template sequence comprises a nucleotide sequence that is at least 80%, or 85%, or 90%, or 95%, or 99% identical to the endogenous DNA target.

Embodiment 66. The complex of embodiment 63, wherein the reverse transcription primer binding site hybridizes with a free 3' end of the cut DNA.

Embodiment 67. The complex of embodiment 63, wherein the optional linker sequence is at least 1 nucleotide, or at least 2, at least 3, at least 4, at least 5, at least 6, at least 7, at least 8, at least 9, at least 10, at least 11, at least 12, at least 13, at least 14, or at least 15 nucleotides in length.

Embodiment 68. A polynucleotide encoding the fusion protein of any of embodiments 1-30.

Embodiment 69. A vector comprising the polynucleotide of embodiment 68.

Embodiment 70. A cell comprising the fusion protein of any of embodiments 1-30 and an extended guide RNA bound to the napDNAbp of the fusion protein.

Embodiment 71. A cell comprising a complex of any one of embodiments 48-67.

Embodiment 72. A pharmaceutical composition comprising: (i) a fusion protein of any of embodiments 1-30, the complex of embodiments 48-67, the polynucleotide of embodiment 68, or the vector of embodiment 69; and (ii) a pharmaceutically acceptable excipient.

Embodiment 73. A pharmaceutical composition comprising: (i) the complex of embodiments 48-67 (ii) reverse transcriptase provided in trans; and (iii) a pharmaceutically acceptable excipient.

Embodiment 74. A kit comprising a nucleic acid construct, comprising: (i) a nucleic acid sequencing encoding the fusion protein of any one of embodiments 1-30; and (ii) a promoter that drives expression of the sequence of (i).

Embodiment 75. A method for installing a desired nucleotide change in a double-stranded DNA sequence, the method comprising:

(i) contacting the double-stranded DNA sequence with a complex comprising a fusion protein and an extended guide RNA, wherein the fusion protein comprises a napDNAbp and a reverse transcriptase and wherein the extended guide RNA comprises a reverse transcription template sequence comprising the desired nucleotide change;

(ii) nicking the double-stranded DNA sequence on the non-target strand, thereby generating a free single-strand DNA having a 3' end;

(iii) hybridizing the 3' end of the free single-strand DNA to the reverse transcription template sequence, thereby priming the reverse transcriptase domain;

(iv) polymerizing a strand of DNA from the 3' end, thereby generating a single-strand DNA flap comprising the desired nucleotide change;

(v) replacing an endogenous DNA strand adjacent the cut site with the single-strand DNA flap, thereby installing the desired nucleotide change in the double-stranded DNA sequence.

Embodiment 76. The method of embodiment 75, wherein the step of (v) replacing comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

Embodiment 77. The method of embodiment 76, wherein the desired nucleotide change is a single nucleotide substitution, a deletion, or an insertion.

Embodiment 78. The method of embodiment 77, wherein the single nucleotide substitution is a transition or a transversion.

Embodiment 79. The method of embodiment 76, wherein the desired nucleotide change is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

Embodiment 80. The method of embodiment 76, wherein the desired nucleoid change converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 81. The method of embodiment 76, wherein the desired nucleotide change is an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 82. The method of embodiment 76, wherein the desired nucleotide change corrects a disease-associated gene.

Embodiment 83. The method of embodiment 82, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease.

Embodiment 84. The method of embodiment 82, wherein the disease-associated gene is associated with a polygenic disorder selected from the group consisting of: heart disease; high blood pressure; Alzheimer's disease; arthritis; diabetes; cancer; and obesity.

Embodiment 85. The method of embodiment 76, wherein the napDNAbp is a nuclease dead Cas9 (dCas9), a Cas9 nickase (nCas9), or a nuclease active Cas9.

Embodiment 86. The method of embodiment 76, wherein the napDNAbp comprises an amino acid sequence of SEQ ID NO: 18.

Embodiment 87. The method of embodiment 76, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 88. The method of embodiment 76, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 89. The method of embodiment 76, wherein the reverse transcriptase domain comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 90. The method of embodiment 76, wherein the extended guide RNA comprises an RNA extension at the 3' or 5' ends or at an intramolecular location in the guide RNA, wherein the RNA extension comprises the reverse transcription template sequence.

Embodiment 91. The method of embodiment 90, wherein the RNA extension is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 92. The method of embodiment 76, wherein the extended guide RNA has a nucleotide sequence selected from the group consisting of SEQ ID NOs: 394, 429-442, 641-649, 678-692, 2997-3103, 3113-3121, 3305-3455, 3479-3493, 3522-3556, 3628-3698, and 3755-3810.

Embodiment 93. A method for introducing one or more changes in the nucleotide sequence of a DNA molecule at a target locus, comprising:
(i) contacting the DNA molecule with a nucleic acid programmable DNA binding protein (napDNAbp) and a guide RNA which targets the napDNAbp to the target locus, wherein the guide RNA comprises a reverse transcriptase (RT) template sequence comprising at least one desired nucleotide change;
(ii) forming an exposed 3' end in a DNA strand at the target locus;
(iii) hybridizing the exposed 3' end to the RT template sequence to prime reverse transcription;
(iv) synthesizing a single strand DNA flap comprising the at least one desired nucleotide change based on the RT template sequence by reverse transcriptase;
(v) and incorporating the at least one desired nucleotide change into the corresponding endogenous DNA, thereby introducing one or more changes in the nucleotide sequence of the DNA molecule at the target locus.

Embodiment 94. The method of embodiment 93, wherein the one or more changes in the nucleotide sequence comprises a transition.

Embodiment 95. The method of embodiment 94, wherein the transition is selected from the group consisting of: (a) T to C; (b) A to G; (c) C to T; and (d) G to A.

Embodiment 96. The method of embodiment 93, wherein the one or more changes in the nucleotide sequence comprises a transversion.

Embodiment 97. The method of embodiment 96, wherein the transversion is selected from the group consisting of: (a) T to A; (b) T to G; (c) C to G; (d) C to A; (e) A to T; (f) A to C; (g) G to C; and (h) G to T.

Embodiment 98. The method of embodiment 93, wherein the one or more changes in the nucleotide sequence comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 99. The method of embodiment 93, wherein the one or more changes in the nucleotide sequence comprises an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 100. The method of embodiment 93, wherein the one or more changes in the nucleotide sequence comprises a correction to a disease-associated gene.

Embodiment 101. The method of embodiment 100, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; and Tay-Sachs Disease.

Embodiment 102. The method of embodiment 100, wherein the disease-associated gene is associated with a polygenic disorder selected from the group consisting of: heart disease; high blood pressure; Alzheimer's disease; arthritis; diabetes; cancer; and obesity.

Embodiment 103. The method of embodiment 93, wherein the napDNAbp is a nuclease active Cas9 or variant thereof.

Embodiment 104. The method of embodiment 93, wherein the napDNAbp is a nuclease inactive Cas9 (dCas9) or Cas9 nickase (nCas9), or a variant thereof.

Embodiment 105. The method of embodiment 93, wherein the napDNAbp comprises an amino acid sequence of SEQ ID NO: 18.

Embodiment 106. The method of embodiment 93, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 107. The method of embodiment 93, wherein the reverse transcriptase is introduced in trans.

Embodiment 108. The method of embodiment 93, wherein the napDNAbp comprises a fusion to a reverse transcriptase.

Embodiment 109. The method of embodiment 93, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 110. The method of embodiment 93, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 111. The method of embodiment 93, wherein the step of forming an exposed 3' end in the DNA strand at the target locus comprises nicking the DNA strand with a nuclease.

Embodiment 112. The method of embodiment 111, wherein the nuclease is the napDNAbp, is provided as a fusion domain of napDNAbp, or is provided in trans.

Embodiment 113. The method of embodiment 93, wherein the step of forming an exposed 3' end in the DNA strand at the target locus comprises contacting the DNA strand with a chemical agent.

Embodiment 114. The method of embodiment 93, wherein the step of forming an exposed 3' end in the DNA strand at the target locus comprises introducing a replication error.

Embodiment 115. The method of embodiment 93, wherein the step of contacting the DNA molecule with the napDNAbp and the guide RNA forms an R-loop.

Embodiment 116. The method of embodiment 115, wherein the DNA strand in which the exposed 3' end is formed is in the R-loop.

Embodiment 117. The method of embodiment 93, wherein guide RNA comprises an extended portion that comprises the reverse transcriptase (RT) template sequence.

Embodiment 118. The method of embodiment 117, wherein the extended portion is at the 3' end of the guide RNA, the 5' end of the guide RNA, or at an intramolecular position in the guide RNA.

Embodiment 119. The method of embodiment 93, wherein the guide RNA further comprises a primer binding site.

Embodiment 120. The method of embodiment 93, wherein the guide RNA further comprises a spacer sequence.

Embodiment 121. The method of embodiment 93, wherein the RT template sequence is homologous to the corresponding endogenous DNA.

Embodiment 122. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change; (b) conducting target-primed reverse transcription of the RT template to generate a single strand DNA comprising the desired nucleotide change; and (c) incorporating the desired nucleotide change into the DNA molecule at the target locus through a DNA repair and/or replication process.

Embodiment 123. The method of embodiment 122, wherein the RT template is located at the 3' end of the guide RNA, the 5' end of the guide RNA, or at an intramolecular location in the guide RNA.

Embodiment 124. The method of embodiment 122, wherein the desired nucleotide change comprises a transition, a transversion, an insertion, or a deletion, or any combination thereof.

Embodiment 125. The method of claim 122, wherein the desired nucleotide change comprises a transition selected from the group consisting of: (a) T to C; (b) A to G; (c) C to T; and (d) G to A.

Embodiment 126. The method of claim 122, wherein the desired nucleotide change comprises a transversion selected from the group consisting of: (a) T to A; (b) T to G; (c) C to G; (d) C to A; (e) A to T; (f) A to C; (g) G to C; and (h) G to T.

Embodiment 127. The method of embodiment 122, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 128. A polynucleotide encoding the extended guide RNA of any one of embodiments 31-47.

Embodiment 129. A vector comprising the polynucleotide of embodiment 128.

Embodiment 130. A cell comprising the vector of embodiment 129.

Embodiment 131. The fusion protein of any of embodiments 1-30, wherein the reverse transcriptase is an error-prone reverse transcriptase.

Embodiment 132. A method for mutagenizing a DNA molecule at a target locus by target-primed reverse transcription, the method comprising: (a) contacting the DNA molecule at the target locus with a (i) fusion protein comprising a nucleic acid programmable DNA binding protein (napDNAbp) and an error-prone reverse transcriptase and (ii) a guide RNA comprising an RT template comprising a desired nucleotide change; (b) conducting target-primed reverse transcription of the RT template to generate a mutagenized single strand DNA; and (c) incorporating the mutagenized single strand DNA into the DNA molecule at the target locus through a DNA repair and/or replication process.

Embodiment 133. The method of embodiment 132, wherein the fusion protein comprises the amino acid sequence of PE1, PE2, or PE3.

Embodiment 134. The method of embodiment 132, wherein the napDNAbp is a Cas9 nickase (nCas9).

Embodiment 135. The method of embodiment 132, wherein the napDNAbp comprises the amino acid sequence of SEQ ID NOs: 18-88, 126, 130, 137, 141, 147, 153, 157, 445, 460, 467, and 482-487.

Embodiment 136. The method of embodiment 132, wherein the guide RNA comprises SEQ ID NO: 222.

Embodiment 137. The method of embodiment 132, wherein the step of (b) conducting target-primed reverse transcription comprises generating a 3' end primer binding sequence at the target locus that is capable of priming reverse transcription by annealing to a primer binding site on the guide RNA.

Embodiment 138. A method for replacing a trinucleotide repeat expansion mutation in a target DNA molecule with a healthy sequence comprising a healthy number of repeat trinucleotides, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising the replacement sequence, wherein said fusion protein intr; (b) conducting target-primed reverse transcription of the RT template to generate a single strand DNA comprising the replacement sequence; and (c) incorporating the single strand DNA into the DNA molecule at the target locus through a DNA repair and/or replication process.

Embodiment 139. The method of embodiment 138, wherein the fusion protein comprises the amino acid sequence of PE1, PE2, or PE3.

Embodiment 140. The method of embodiment 138, wherein the napDNAbp is a Cas9 nickase (nCas9).

Embodiment 141. The method of embodiment 138, wherein the napDNAbp comprises the amino acid sequence of SEQ ID NOs: 18-88, 126, 130, 137, 141, 147, 153, 157, 445, 460, 467, and 482-487.

Embodiment 142. The method of embodiment 138, wherein the guide RNA comprises SEQ ID NO: 222.

Embodiment 143. The method of embodiment 138, wherein the step of (b) conducting target-primed reverse transcription comprises generating a 3' end primer binding sequence at the target locus that is capable of priming reverse transcription by annealing to a primer binding site on the guide RNA.

Embodiment 144. The method of embodiment 138, wherein the trinucleotide repeat expansion mutation is associated with Huntington's Disease, Fragile X syndrome, or Friedreich's ataxia.

Embodiment 145. The method of embodiment 138, wherein the trinucleotide repeat expansion mutation comprises a repeating unit of CAG triplets.

Embodiment 146. The method of embodiment 138, wherein the trinucleotide repeat expansion mutation comprises a repeating unit of GAA triplets.

Embodiment 147. A method of installing a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the functional moiety; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the functional moiety.

Embodiment 148. The method of embodiment 147, wherein functional moiety is peptide tag.

Embodiment 149. The method of embodiment 148, wherein the peptide tag is an affinity tag, solubilization tag, chromatography tag, epitope tag, or a fluorescence tag.

Embodiment 150. The method of embodiment 148, wherein the peptide tag is selected from the group consisting of: AviTag (SEQ ID NO: 245); C-tag (SEQ ID NO: 246); Calmodulin-tag (SEQ ID NO: 247); polyglutamate tag (SEQ ID NO: 248); E-tag (SEQ ID NO: 249); FLAG-tag (SEQ ID NO: 2); HA-tag (SEQ ID NO: 5); His-tag (SEQ ID NOs: 252-262); Myc-tag (SEQ ID NO: 6); NE-tag (SEQ ID NO: 264); Rho1D4-tag (SEQ ID NO: 265); S-tag (SEQ ID NO: 266); SBP-tag (SEQ ID NO: 267); Softag-1 (SEQ ID NO: 268); Softag-2 (SEQ ID NO: 269); Spot-tag (SEQ ID NO: 270); Strep-tag (SEQ ID NO: 271); TC tag (SEQ ID NO: 272); Ty tag (SEQ ID NO: 273); V5 tag (SEQ ID NO: 3); VSV-tag (SEQ ID NO: 275); and Xpress tag (SEQ ID NO: 276).

Embodiment 151. The method of embodiment 148, wherein the peptide tag is selected from the group consisting of: AU1 epitope (SEQ ID NO: 278); AU5 epitope (SEQ ID NO: 279); Bacteriophage T7 epitope (T7-tag) (SEQ ID NO: 280); Bluetongue virus tag (B-tag) (SEQ ID NO: 281); E2 epitope (SEQ ID NO: 282); Histidine affinity tag (HAT) (SEQ ID NO: 283); HSV epitope (SEQ ID NO: 284); Polyarginine (Arg-tag) (SEQ ID NO: 285); Polyaspartate (Asp-tag) (SEQ ID NO: 286); Polyphenylalanine (Phe-tag) (SEQ ID NO: 287); 51-tag (SEQ ID NO: 288); S-tag (SEQ ID NO: 266); and VSV-G (SEQ ID NO: 275).

Embodiment 152. The method of embodiment 147, wherein the functional moiety is an immunoepitope.

Embodiment 153. The method of embodiment 152, wherein the immunoepitope is selected from the group consisting of: tetanus toxoid (SEQ ID NO: 396); diphtheria toxin mutant CRM197 (SEQ ID NO: 398); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

Embodiment 154. The method of embodiment 147, wherein the functional moiety alters the localization of the protein of interest.

Embodiment 155. The method of embodiment 147, wherein the functional moiety is a degradation tag such that the degradation rate of the protein of interest is altered.

Embodiment 156. The method of embodiment 155, wherein the degradation tag comprises an amino acid sequence encoding the degradation tags as disclosed herein.

Embodiment 157. The method of embodiment 147, wherein the functional moiety is a small molecule binding domain.

Embodiment 158. The method of embodiment 157, wherein the small molecule binding domain is FKBP12 of SEQ ID NO: 488.

Embodiment 159. The method of embodiment 157, wherein the small molecule binding domain is FKBP12-F36V of SEQ ID NO: 489.

Embodiment 160. The method of embodiment 157, wherein the small molecule binding domain is cyclophilin of SEQ ID NOs: 490 and 493-494.

Embodiment 161. The method of embodiment 157, wherein the small molecule binding domain is installed in two or more proteins of interest.

Embodiment 162. The method of embodiment 161, wherein the two or more proteins of interest may dimerize upon contacting with a small molecule.

Embodiment 163. The method of embodiment 157, wherein the small molecule is a dimer of a small molecule selected from the group consisting of those compounds disclosed in Embodiment 163 of Group 1, above.

Embodiment 164. A method of installing an immunoepitope in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the immunoepitope.

Embodiment 165. The method of embodiment 164, wherein the immunoepitope is selected from the group consisting of: tetanus toxoid (SEQ ID NO: 396); diphtheria toxin mutant CRM197 (SEQ ID NO: 630); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1

(SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

Embodiment 166. The method of embodiment 164, wherein the fusion protein comprises the amino acid sequence of PE1, PE2, or PE3.

Embodiment 167. The method of embodiment 164, wherein the napDNAbp is a Cas9 nickase (nCas9).

Embodiment 168. The method of embodiment 164, wherein the napDNAbp comprises the amino acid sequence of SEQ ID NOs: 18-88, 126, 130, 137, 141, 147, 153, 157, 445, 460, 467, and 482-487.

Embodiment 169. The method of embodiment 164, wherein the guide RNA comprises SEQ ID NO: 222.

Embodiment 170. A method of installing a small molecule dimerization domain in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the small molecule dimerization domain; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the small molecule dimerization domain.

Embodiment 171. The method of embodiment 170, further comprising conducting the method on a second protein of interest.

Embodiment 172. The method of embodiment 171, wherein the first protein of interest and the second protein of interest dimerize in the presence of a small molecule that binds to the dimerization domain on each of said proteins.

Embodiment 173. The method of embodiment 170, wherein the small molecule binding domain is FKBP12 of SEQ ID NO: 488.

Embodiment 174. The method of embodiment 170, wherein the small molecule binding domain is FKBP12-F36V of SEQ ID NO: 489.

Embodiment 175. The method of embodiment 170, wherein the small molecule binding domain is cyclophilin of SEQ ID NOs: 490 and 493-494.

Embodiment 176. The method of embodiment 170, wherein the small molecule is a dimer of a small molecule selected from the group consisting of the compounds disclosed in Embodiment 163 of Group 1, above.

Embodiment 177. The method of embodiment 170, wherein the fusion protein comprises the amino acid sequence of PE1, PE2, or PE3.

Embodiment 178. The method of embodiment 170, wherein the napDNAbp is a Cas9 nickase (nCas9).

Embodiment 179. The method of embodiment 170, wherein the napDNAbp comprises the amino acid sequence of SEQ ID NOs: 18-88, 126, 130, 137, 141, 147, 153, 157, 445, 460, 467, and 482-487.

Embodiment 180. The method of embodiment 170, wherein the guide RNA comprises SEQ ID NO: 222.

Embodiment 181. A method of installing a peptide tag or epitope onto a protein using prime editing, comprising: contacting a target nucleotide sequence encoding the protein with a prime editor construct configured to insert therein a second nucleotide sequence encoding the peptide tag to result in a recombinant nucleotide sequence, such that the peptide tag and the protein are expressed from the recombinant nucleotide sequence as a fusion protein.

Embodiment 182. The method of embodiment 181, wherein the peptide tag is used for purification and/or detection of the protein.

Embodiment 183. The method of embodiment 181, wherein the peptide tag is a poly-histidine (e.g., HHHHHH) (SEQ ID NOs: 252-262), FLAG (e.g., DYKDDDDK) (SEQ ID NO: 2), V5 (e.g., GKPIPNPLLGLDST) (SEQ ID NO: 3), GCN4, HA (e.g., YPYDVPDYA) (SEQ ID NO: 5), Myc (e.g. EQKLISEED) (SEQ ID NO: 6), GST . . . etc.

Embodiment 184. The method of embodiment 181, wherein the peptide tag has an amino acid sequence selected from the group consisting of SEQ ID NO: 1-6, 245-249, 252-262, 264-273, 275-276, 281, 278-288, and 622.

Embodiment 185. The method of embodiment 181, wherein the peptide tag is fused to the protein by a linker.

Embodiment 186. The method of embodiment 181, wherein the fusion protein has the following structure: [protein]-[peptide tag] or [peptide tag]-[protein], wherein "]-[" represents an optional linker.

Embodiment 187. The method of embodiment 181, wherein the linker has an amino acid sequence of SEQ ID NO: 127, 165-176, 446, 453, and 767-769.

Embodiment 188. The method of embodiment 181, wherein the prime editor construct comprises a PEgRNA comprising the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 189. The method of embodiment 181, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 190. The method of embodiment 181, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 191. A method of preventing or halting the progression of a prion disease by installing on or more protective mutations into PRNP encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety; (b) polymerizing a single strand DNA sequence encoding the protective mutation; and (c) incorporating the single strand DNA sequence in place of a corresponding endogenous strand at the target nucleotide sequence through a DNA repair and/or replication process, wherein the method produces a recombinant target nucleotide sequence that encodes a PRNP comprising a protective mutation and which is resistant to misfolding.

Embodiment 192. The method of embodiment 191, wherein the prion disease is a human prion disease.

Embodiment 193. The method of embodiment 191, wherein the prion disease is an animal prion disease.

Embodiment 194. The method of embodiment 192, wherein the prion disease is Creutzfeldt-Jakob Disease (CJD), Variant Creutzfeldt-Jakob Disease (vCJD), Gerstmann-Straussler-Scheinker Syndrome, Fatal Familial Insomnia, or Kuru.

Embodiment 195. The method of embodiment 193, wherein the prion disease is Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy.

Embodiment 196. The method of embodiment 191, wherein the wildtype PRNP amino acid sequence is SEQ ID NOs: 291-292.

Embodiment 197. The method of embodiment 191, wherein the method results in a modified PRNP amino acid sequence selected from the group consisting of SEQ ID NOs: 293-309, and 311-323, wherein said modified PRNP protein is resistant to misfolding.

Embodiment 198. The method of embodiment 191, wherein the fusion protein comprises the amino acid sequence of PE1, PE2, or PE3.

Embodiment 199. The method of embodiment 191, wherein the napDNAbp is a Cas9 nickase (nCas9).

Embodiment 200. The method of embodiment 191, wherein the napDNAbp comprises the amino acid sequence of SEQ ID NOs: 18-88, 126, 130, 137, 141, 147, 153, 157, 445, 460, 467, and 482-487.

Embodiment 201. The method of embodiment 191, wherein the guide RNA comprises SEQ ID NO: 222.

Embodiment 202. A method of installing a ribonucleotide motif or tag in an RNA of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the ribonucleotide motif or tag; (b) polymerizing a single strand DNA sequence encoding the ribonucleotide motif or tag; and (c) incorporating the single strand DNA sequence in place of a corresponding endogenous strand at the target nucleotide sequence through a DNA repair and/or replication process, wherein the method produces a recombinant target nucleotide sequence that encodes a modified RNA of interest comprising the ribonucleotide motif or tag.

Embodiment 203. The method of embodiment 202, wherein ribonucleotide motif or tag is a detection moiety.

Embodiment 204. The method of embodiment 202, wherein the ribonucleotide motif or tag affects the expression level of the RNA of interest.

Embodiment 205. The method of embodiment 202, wherein the ribonucleotide motif or tag affects the transport or subcellular location of the RNA of interest.

Embodiment 206. The method of embodiment 202, wherein the ribonucleotide motif or tag is selected from the group consisting of SV40 type 1, SV40 type 2, SV40 type 3, hGH, BGH, rbGlob, TK, MALAT1 ENE-mascRNA, KSHV PAN ENE, Smbox/U1 snRNA box, U1 snRNA 3' box, tRNA-lysine, broccoli aptamer, spinach aptamer, mango aptamer, HDV ribozyme, and m6A.

Embodiment 207. The method of embodiment 202, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 208. The method of embodiment 202, wherein the fusion protein comprises the amino acid sequence of PE1, PE2, or PE3.

Embodiment 209. The method of embodiment 202, wherein the napDNAbp is a Cas9 nickase (nCas9).

Embodiment 210. The method of embodiment 202, wherein the napDNAbp comprises the amino acid sequence of SEQ ID NOs: 18-88, 126, 130, 137, 141, 147, 153, 157, 445, 460, 467, and 482-487.

Embodiment 211. A method of installing or deleting a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a reverse transcriptase and (ii) a PEgRNA comprising an edit template encoding the functional moiety or deletion of same; (b) polymerizing a single strand DNA sequence encoding the functional moiety or deletion of same; and (c) incorporating the single strand DNA sequence in place of a corresponding endogenous strand at the target nucleotide sequence through a DNA repair and/or replication process, wherein the method produces a recombinant target nucleotide sequence that encodes a modified protein comprising the protein of interest and the functional moiety or the removal of same, wherein the functional moiety alters a modification state or localization state of the protein.

Embodiment 212. The method of embodiment 211, wherein functional moiety alters the phosphorylation, ubiquitylation, glycosylation, lipidation, hydroxylation, methylation, acetylation, crotonylation, SUMOylation state of the protein of interest.

Embodiment 213. A fusion protein comprising a nucleic acid programmable DNA binding protein (napDNAbp) and a polymerase.

Embodiment 214. The fusion protein of embodiment 213, wherein the fusion protein is capable of carrying out prime editing in the presence of an prime editing guide RNA (PEgRNA).

Embodiment 215. The fusion protein of embodiment 213, wherein the napDNAbp has a nickase activity.

Embodiment 216. The fusion protein of embodiment 213, wherein the napDNAbp is a Cas9 protein or variant thereof.

Embodiment 217. The fusion protein of embodiment 213, wherein the napDNAbp is a nuclease active Cas9, a nuclease inactive Cas9 (dCas9), or a Cas9 nickase (nCas9).

Embodiment 218. The fusion protein of embodiment 213, wherein the napDNAbp is Cas9 nickase (nCas9).

Embodiment 219. The fusion protein of embodiment 213, wherein the napDNAbp is selected from the group consisting of: Cas9, Cas12e, Cas12d, Cas12a, Cas12b1, Cas13a, Cas12c, and Argonaute and optionally has a nickase activity.

Embodiment 220. The fusion protein of embodiment 213, wherein the fusion protein when complexed with a PEgRNA is capable of binding to a target DNA sequence.

Embodiment 221. The fusion protein of embodiment 220, wherein the target DNA sequence comprises a target strand and a complementary non-target strand.

Embodiment 222. The fusion protein of embodiment 220, wherein the binding of the fusion protein complexed to the PEgRNA forms an R-loop.

Embodiment 223. The fusion protein of embodiment 222, wherein the R-loop comprises (i) an RNA-DNA hybrid comprising the PEgRNA and the target strand, and (ii) the complementary non-target strand.

Embodiment 224. The fusion protein of embodiment 223, wherein the complementary non-target strand is nicked to form a priming sequence having a free 3' end.

Embodiment 225. The fusion protein of embodiment 214, wherein the PEgRNA comprises (a) a guide RNA and (b) an extension arm at the 5' or the 3' end of the guide RNA, or at an intramolecular location in the guide RNA.

Embodiment 226. The fusion protein of embodiment 225, wherein the extension arm comprises (i) a DNA synthesis template sequence comprising a desired nucleotide change, and (ii) a primer binding site.

Embodiment 227. The fusion protein of embodiment 226, wherein the DNA synthesis template sequence encodes a single-strand DNA flap that is complementary to an endogenous DNA sequence adjacent to the nick site, wherein the single-strand DNA flap comprises the desired nucleotide change.

Embodiment 228. The fusion protein of embodiment 225, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 229. The fusion protein of embodiment 227, wherein the single-strand DNA flap hybridizes to the endogenous DNA sequence adjacent to the nick site, thereby installing the desired nucleotide change.

Embodiment 230. The fusion protein of embodiment 227, wherein the single-stranded DNA flap displaces the endogenous DNA sequence adjacent to the nick site and which has a free 5' end.

Embodiment 231. The fusion protein of embodiment 230, wherein the endogenous DNA sequence having the 5' end is excised by the cell.

Embodiment 232. The fusion protein of embodiment 230, wherein cellular repair of the single-strand DNA flap results in installation of the desired nucleotide change, thereby forming a desired product.

Embodiment 233. The fusion protein of embodiment 226, wherein the desired nucleotide change is installed in an editing window that is between about −4 to +10 of the PAM sequence, or between about −10 to +20 of the PAM sequence, or between about −20 to +40 of the PAM sequence, or between about −30 to +100 of the PAM sequence, or wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.

Embodiment 234. The fusion protein of embodiment 213, wherein the napDNAbp comprises an amino acid sequence of SEQ ID NO: 18, or an amino acid sequence having at least 80%, 85%, 90%, 95%, 98%, or 99% sequence identity with the amino acid sequence to SEQ ID NO: 18.

Embodiment 235. The fusion protein of embodiment 213, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 236. The fusion protein of embodiment 213, wherein the polymerase is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 237. The fusion protein of embodiment 213, wherein the polymerase is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 238. The fusion protein of embodiment 213, wherein the polymerase is a naturally-occurring reverse transcriptase from a retrovirus or a retrotransposon.

Embodiment 239. The fusion protein of any one of the previous embodiments, wherein the fusion protein comprises the structure NH2-[napDNAbp]-[polymerase]-COOH; or NH2-[polymerase]-[napDNAbp]-COOH, wherein each instance of "]-[" indicates the presence of an optional linker sequence.

Embodiment 240. The fusion protein of embodiment 239, wherein the linker sequence comprises an amino acid sequence of SEQ ID NOs: 127, 165-176, 446, 453, and 767-769.

Embodiment 241. The fusion protein of embodiment 226, wherein the desired nucleotide change is a single nucleotide change, an insertion of one or more nucleotides, or a deletion of one or more nucleotides.

Embodiment 242. The fusion protein of embodiment 241, wherein the insert or deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, or at least 50.

Embodiment 243. A PEgRNA comprising a guide RNA and at least one nucleic acid extension arm comprising a DNA synthesis template.

Embodiment 244. The PEgRNA of embodiment 241, wherein the nucleic acid extension arm is position at the 3' or 5' end of the guide RNA, or at an intramolecular position in the guide RNA, and wherein the nucleic acid extension arm is DNA or RNA.

Embodiment 245. The PEgRNA of embodiment 242, wherein the PEgRNA is capable of binding to a napDNAbp and directing the napDNAbp to a target DNA sequence.

Embodiment 246. The PEgRNA of embodiment 245, wherein the target DNA sequence comprises a target strand and a complementary non-target strand, wherein the guide RNA hybridizes to the target strand to form an RNA-DNA hybrid and an R-loop.

Embodiment 247. The PEgRNA of embodiment 243, wherein the at least one nucleic acid extension arm comprises (i) a DNA synthesis template, and (ii) a primer binding site.

Embodiment 248. The PEgRNA of embodiment 247, wherein the nucleic acid extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 249. The PEgRNA of embodiment 247, wherein the DNA synthesis template is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 250. The PEgRNA of embodiment 247, wherein the primer binding site is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 251. The PEgRNA of embodiment 243, further comprising at least one additional structure selected from the group consisting of a linker, a stem loop, a hairpin, a toeloop, an aptamer, or an RNA-protein recruitment domain.

Embodiment 252. The PEgRNA of embodiment 247, wherein the DNA synthesis template encodes a single-strand DNA flap that is complementary to an endogenous DNA sequence adjacent to a nick site, wherein the single-strand DNA flap comprises a desired nucleotide change.

Embodiment 253. The PEgRNA of embodiment 252, wherein the single-stranded DNA flap displaces an endogenous single-strand DNA having a 5' end in the target DNA sequence that has been nicked, and wherein the endogenous single-strand DNA is immediately adjacent downstream of the nick site.

Embodiment 254. The PEgRNA of embodiment 253, wherein the endogenous single-stranded DNA having the free 5' end is excised by the cell.

Embodiment 255. The PEgRNA of embodiment 253, wherein cellular repair of the single-strand DNA flap results in installation of the desired nucleotide change, thereby forming a desired product.

Embodiment 256. The PEgRNA of embodiment 243, comprising the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 257. The PEgRNA of embodiment 247, wherein the DNA synthesis template comprises a nucleotide sequence that is at least 80%, or 85%, or 90%, or 95%, or 99% identical to the endogenous DNA target.

Embodiment 258. The PEgRNA of embodiment 247, wherein the primer binding site hybridizes with a free 3' end of the cut DNA.

Embodiment 259. The PEgRNA of embodiment 251, wherein the at least one additional structure is located at the 3' or 5' end of the PEgRNA.

Embodiment 260. A complex comprising comprising a fusion protein of any one of embodiments 213-242 and an PEgRNA.

Embodiment 261. The complex of embodiment 260, wherein the PEgRNA comprises a guide RNA and an nucleic acid extension arm at the 3' or 5' end of the guide RNA or at an intramolecular position in the guide RNA.

Embodiment 262. The complex of embodiment 260, wherein the PEgRNA is capable of binding to a napDNAbp and directing the napDNAbp to a target DNA sequence.

Embodiment 263. The complex of embodiment 262, wherein the target DNA sequence comprises a target strand and a complementary non-target strand, wherein the guide RNA hybridizes to the target strand to form an RNA-DNA hybrid and an R-loop.

Embodiment 264. The complex of embodiment 261, wherein the at least one nucleic acid extension arm comprises (i) a DNA synthesis template, and (ii) a primer binding site.

Embodiment 265. The complex of embodiment 260, wherein the PEgRNA comprises the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 266. The complex of embodiment 264, wherein the DNA synthesis template comprises a nucleotide sequence that is at least 80%, or 85%, or 90%, or 95%, or 99% identical to the endogenous DNA target.

Embodiment 267. The complex of embodiment 264, wherein the primer binding site hybridizes with a free 3' end of the cut DNA.

Embodiment 268. A complex comprising comprising a napDNAbp and an PEgRNA.

Embodiment 269. The complex of embodiment 268, wherein the napDNAbp is a Cas9 nickase.

Embodiment 270. The complex of embodiment 268, wherein the napDNAbp comprises an amino acid sequence of SEQ ID NO: 18.

Embodiment 271. The complex of embodiment 268, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 272. The complex of embodiment 268, wherein the PEgRNA comprises a guide RNA and a nucleic acid extension arm at the 3' or 5' end of the guide RNA, or at an intramolecular position in the guide RNA.

Embodiment 273. The complex of embodiment 268, wherein the PEgRNA is capable of directing the napDNAbp to a target DNA sequence.

Embodiment 274. The complex of embodiment 272, wherein the target DNA sequence comprises a target strand and a complementary non-target strand, wherein the spacer sequence of the PEgRNA hybridizes to the target strand to form an RNA-DNA hybrid and an R-loop.

Embodiment 275. The complex of embodiment 273, wherein the nucleic acid extension arm comprises (i) a DNA synthesis template, and (ii) a primer binding site.

Embodiment 276. The complex of embodiment 269, wherein the PEgRNA comprises the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 277. The complex of embodiment 276, wherein the DNA synthesis template comprises a nucleotide sequence that is at least 80%, or 85%, or 90%, or 95%, or 99% identical to the endogenous DNA target.

Embodiment 278. The complex of embodiment 276, wherein the primer binding site hybridizes with a free 3' end of the cut DNA.

Embodiment 279. The complex of embodiment 276, wherein the PEgRNA further comprises at least one additional structure selected from the group consisting of a linker, a stem loop, a hairpin, a toeloop, an aptamer, or an RNA-protein recruitment domain.

Embodiment 280. A polynucleotide encoding the fusion protein of any of embodiments 213-242.

Embodiment 281. A vector comprising the polynucleotide of embodiment 280.

Embodiment 282. A cell comprising the fusion protein of any of embodiments 213-242 and an PEgRNA bound to the napDNAbp of the fusion protein.

Embodiment 283. A cell comprising a complex of any one of embodiments 260-279.

Embodiment 284. A pharmaceutical composition comprising: (i) a fusion protein of any of embodiments 213-242, the complex of embodiments 260-279, the polynucleotide of embodiment 68, or the vector of embodiment 69; and (ii) a pharmaceutically acceptable excipient.

Embodiment 285. A pharmaceutical composition comprising: (i) the complex of embodiments 260-279 (ii) a polymerase provided in trans; and (iii) a pharmaceutically acceptable excipient.

Embodiment 286. A kit comprising a nucleic acid construct, comprising: (i) a nucleic acid sequencing encoding the fusion protein of any one of embodiments 213-242; and (ii) a promoter that drives expression of the sequence of (i).

Embodiment 287. A method for installing a desired nucleotide change in a double-stranded DNA sequence, the method comprising:
(i) contacting the double-stranded DNA sequence with a complex comprising a fusion protein and a PEgRNA, wherein the fusion protein comprises a napDNAbp and a polymerase and wherein the PEgRNA comprises a DNA synthesis template comprising the desired nucleotide change and a primer binding site;
(ii) nicking the double-stranded DNA sequence, thereby generating a free single-strand DNA having a 3' end;
(iii) hybridizing the 3' end of the free single-strand DNA to the primer binding site, thereby priming the polymerase;
(iv) polymerizing a strand of DNA from the 3' end hybridized to the primer binding site, thereby generating a single-strand DNA flap comprising the desired nucleotide change and which is complementary to the DNA synthesis template;
(v) replacing an endogenous DNA strand adjacent the cut site with the single-strand DNA flap, thereby installing the desired nucleotide change in the double-stranded DNA sequence.

Embodiment 288. The method of embodiment 287, wherein the step of (v) replacing comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

Embodiment 289. The method of embodiment 288, wherein the desired nucleotide change is a single nucleotide substitution, a deletion, or an insertion.

Embodiment 290. The method of embodiment 289, wherein the single nucleotide substitution is a transition or a transversion.

Embodiment 291. The method of embodiment 288, wherein the desired nucleotide change is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

Embodiment 292. The method of embodiment 288, wherein the desired nucleoid change converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, a C:G basepair to an A:T basepair, (10) an A:T basepair to a T:A basepair, (11) an A:T basepair to a G:C basepair, or (12) an A:T basepair to a C:G basepair.

Embodiment 293. The method of embodiment 288, wherein the desired nucleotide change is an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 294. The method of embodiment 288, wherein the desired nucleotide change corrects a disease-associated gene.

Embodiment 295. The method of embodiment 294, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

Embodiment 296. The method of embodiment 294, wherein the disease-associated gene is associated with a polygenic disorder selected from the group consisting of: heart disease; high blood pressure; Alzheimer's disease; arthritis; diabetes; cancer; and obesity.

Embodiment 297. The method of embodiment 287, wherein the napDNAbp is a nuclease dead Cas9 (dCas9), a Cas9 nickase (nCas9), or a nuclease active Cas9.

Embodiment 298. The method of embodiment 287, wherein the napDNAbp comprises an amino acid sequence of SEQ ID NO: 18, or an amino acid sequence having at least 80%, 85%, 90%, 95%, 98%, or 99% sequence identity with the amino acid sequence of SEQ ID NO: 18.

Embodiment 299. The method of embodiment 287, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 300. The method of embodiment 287, wherein the polymerase is a reverse transcriptase comprising any one of the amino acid sequences of SEQ ID NOs:

89-100, 105-122, 128-129, 132, 139, 143, 149, 154, 159, 235, 454, 471, 516, 662, 700, 701-716, 739-741, and 766.

Embodiment 301. The method of embodiment 287, wherein the polymerase is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 302. The method of embodiment 287, wherein the PEgRNA comprises a nucleic acid extension arm at the 3' or 5' ends or at an intramolecular location in the guide RNA, wherein the extension arm comprises the DNA synthesis template sequence and the primer binding site.

Embodiment 303. The method of embodiment 302, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 304. The method of embodiment 287, wherein the PEgRNA has a nucleotide sequence selected from the group consisting of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 305. A method for introducing one or more changes in the nucleotide sequence of a DNA molecule at a target locus, comprising:
(i) contacting the DNA molecule with a nucleic acid programmable DNA binding protein (napDNAbp) and a PEgRNA which targets the napDNAbp to the target locus, wherein the PEgRNA comprises a reverse transcriptase (RT) template sequence comprising at least one desired nucleotide change and a primer binding site;
(ii) forming an exposed 3' end in a DNA strand at the target locus;
(iii) hybridizing the exposed 3' end to the primer binding site to prime reverse transcription;
(iv) synthesizing a single strand DNA flap comprising the at least one desired nucleotide change based on the RT template sequence by reverse transcriptase;
(v) and incorporating the at least one desired nucleotide change into the corresponding endogenous DNA, thereby introducing one or more changes in the nucleotide sequence of the DNA molecule at the target locus.

Embodiment 306. The method of embodiment 305, wherein the one or more changes in the nucleotide sequence comprises a transition.

Embodiment 307. The method of embodiment 306, wherein the transition is selected from the group consisting of: (a) T to C; (b) A to G; (c) C to T; and (d) G to A.

Embodiment 308. The method of embodiment 305, wherein the one or more changes in the nucleotide sequence comprises a transversion.

Embodiment 309. The method of embodiment 308, wherein the transversion is selected from the group consisting of: (a) T to A; (b) T to G; (c) C to G; (d) C to A; (e) A to T; (f) A to C; (g) G to C; and (h) G to T.

Embodiment 310. The method of embodiment 305, wherein the one or more changes in the nucleotide sequence comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (9) an A:T basepair to a T:A basepair, (11) an A:T basepair to a G:C basepair, or (12) an A:T basepair to a C:G basepair.

Embodiment 311. The method of embodiment 305, wherein the one or more changes in the nucleotide sequence comprises an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 312. The method of embodiment 305, wherein the one or more changes in the nucleotide sequence comprises a correction to a disease-associated gene.

Embodiment 313. The method of embodiment 312, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

Embodiment 314. The method of embodiment 312, wherein the disease-associated gene is associated with a polygenic disorder selected from the group consisting of: heart disease; high blood pressure; Alzheimer's disease; arthritis; diabetes; cancer; and obesity.

Embodiment 315. The method of embodiment 305, wherein the napDNAbp is a nuclease active Cas9 or variant thereof.

Embodiment 316. The method of embodiment 305, wherein the napDNAbp is a nuclease inactive Cas9 (dCas9) or Cas9 nickase (nCas9), or a variant thereof.

Embodiment 317. The method of embodiment 305, wherein the napDNAbp comprises an amino acid sequence of SEQ ID NO: 18, or an amino acid sequence having at least 80%, 85%, 90%, 95%, 98%, or 99% sequence identity with SEQ ID NO: 18.

Embodiment 318. The method of embodiment 305, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 319. The method of embodiment 305, wherein the reverse transcriptase is introduced in trans.

Embodiment 320. The method of embodiment 305, wherein the napDNAbp comprises a fusion to a reverse transcriptase.

Embodiment 321. The method of embodiment 305, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 322. The method of embodiment 305, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 323. The method of embodiment 305, wherein the step of forming an exposed 3' end in the DNA strand at the target locus comprises nicking the DNA strand with a nuclease.

Embodiment 324. The method of embodiment 323, wherein the nuclease is provided is provided in trans.

Embodiment 325. The method of embodiment 305, wherein the step of forming an exposed 3' end in the DNA strand at the target locus comprises contacting the DNA strand with a chemical agent.

Embodiment 326. The method of embodiment 305, wherein the step of forming an exposed 3' end in the DNA strand at the target locus comprises introducing a replication error.

Embodiment 327. The method of embodiment 305, wherein the step of contacting the DNA molecule with the napDNAbp and the guide RNA forms an R-loop.

Embodiment 328. The method of embodiment 327, wherein the DNA strand in which the exposed 3' end is formed is in the R-loop.

Embodiment 329. The method of embodiment 315, wherein the PEgRNA comprises an extension arm that comprises the reverse transcriptase (RT) template sequence and the primer binding site.

Embodiment 330. The method of embodiment 329, wherein the extension arm is at the 3' end of the guide RNA, the 5' end of the guide RNA, or at an intramolecular position in the guide RNA.

Embodiment 331. The method of embodiment 305, wherein the PEgRNA further comprises at least one additional structure selected from the group consisting of a linker, a stem loop, a hairpin, a toeloop, an aptamer, or an RNA-protein recruitment domain.

Embodiment 332. The method of embodiment 305, wherein the PEgRNA further comprises a homology arm.

Embodiment 333. The method of embodiment 305, wherein the RT template sequence is homologous to the corresponding endogenous DNA.

Embodiment 334. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change; (b) conducting target-primed reverse transcription of the RT template to generate a single strand DNA comprising the desired nucleotide change; and (c) incorporating the desired nucleotide change into the DNA molecule at the target locus through a DNA repair and/or replication process.

Embodiment 335. The method of embodiment 334, wherein the RT template is located at the 3' end of the guide RNA, the 5' end of the guide RNA, or at an intramolecular location in the guide RNA.

Embodiment 336. The method of embodiment 334, wherein the desired nucleotide change comprises a transition, a transversion, an insertion, or a deletion, or any combination thereof.

Embodiment 337. The method of embodiment 334, wherein the desired nucleotide change comprises a transition selected from the group consisting of: (a) T to C; (b) A to G; (c) C to T; and (d) G to A.

Embodiment 338. The method of claim 334, wherein the desired nucleotide change comprises a transversion selected from the group consisting of: (a) T to A; (b) T to G; (c) C to G; (d) C to A; (e) A to T; (f) A to C; (g) G to C; and (h) G to T.

Embodiment 339. The method of embodiment 334, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 340. A polynucleotide encoding the PEgRNA of any one of embodiments 243-259.

Embodiment 341. A vector comprising the polynucleotide of embodiment 340.

Embodiment 342. A cell comprising the vector of embodiment 341.

Embodiment 343. The fusion protein of embodiment 213, wherein the polymerase is an error-prone reverse transcriptase.

Embodiment 344. A method for mutagenizing a DNA molecule at a target locus by target-primed reverse transcription, the method comprising: (a) contacting the DNA molecule at the target locus with a (i) fusion protein comprising a nucleic acid programmable DNA binding protein (napDNAbp) and an error-prone reverse transcriptase and (ii) a guide RNA comprising an RT template comprising a desired nucleotide change; (b) conducting target-primed reverse transcription of the RT template to generate a mutagenized single strand DNA; and (c) incorporating the mutagenized single strand DNA into the DNA molecule at the target locus through a DNA repair and/or replication process.

Embodiment 345. The method of any prior embodiment, wherein the fusion protein comprises the amino acid sequence of PE1, PE2, or PE3.

Embodiment 346. The method of any prior embodiment, wherein the napDNAbp is a Cas9 nickase (nCas9).

Embodiment 347. The method of embodiment 344, wherein the napDNAbp comprises the amino acid sequence of SEQ ID NOs: 18-88, 126, 130, 137, 141, 147, 153, 157, 445, 460, 467, and 482-487.

Embodiment 348. The method of embodiment 344, wherein the guide RNA comprises SEQ ID NO: 222.

Embodiment 349. The method of embodiment 344, wherein the step of (b) conducting target-primed reverse transcription comprises generating a 3' end primer binding sequence at the target locus that is capable of priming reverse transcription by annealing to a primer binding site on the guide RNA.

Embodiment 350. A method for replacing a trinucleotide repeat expansion mutation in a target DNA molecule with a healthy sequence comprising a healthy number of repeat trinucleotides, the method comprising: (a) contacting the DNA molecule at the target locus with a (i) fusion protein comprising a nucleic acid programmable DNA binding protein (napDNAbp) and a polymerase and (ii) a PEgRNA comprising DNA synthesis template comprising the replacement sequence and a primer binding site; (b) conducting prime editing to generate a single strand DNA comprising the replacement sequence; and (c) incorporating the single strand DNA into the DNA molecule at the target locus through a DNA repair and/or replication process.

Embodiment 351. The method of embodiment 350, wherein the fusion protein comprises the amino acid sequence of PE1, PE2, or PE3.

Embodiment 352. The method of embodiment 350, wherein the napDNAbp is a Cas9 nickase (nCas9).

Embodiment 353. The method of embodiment 350, wherein the napDNAbp comprises the amino acid sequence of SEQ ID NOs: 18-88, 126, 130, 137, 141, 147, 153, 157, 445, 460, 467, and 482-487.

Embodiment 354. The method of embodiment 350, wherein the guide RNA comprises SEQ ID NO: 222.

Embodiment 355. The method of embodiment 350, wherein the step of (b) conducting prime editing comprises generating a 3' end primer binding sequence at the target locus that is capable of priming polymerase by annealing to the primer binding site on the guide RNA.

Embodiment 356. The method of embodiment 350, wherein the trinucleotide repeat expansion mutation is associated with Huntington's Disease, Fragile X syndrome, or Friedreich's ataxia.

Embodiment 357. The method of embodiment 350, wherein the trinucleotide repeat expansion mutation comprises a repeating unit of CAG triplets.

Embodiment 358. The method of embodiment 350, wherein the trinucleotide repeat expansion mutation comprises a repeating unit of GAA triplets.

Embodiment 359. A method of installing a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising DNA synthesis template encoding the functional moiety; (b) polymerizing a single strand DNA sequence encoding the functional moiety; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the functional moiety.

Embodiment 360. The method of embodiment 359, wherein functional moiety is peptide tag.

Embodiment 361. The method of embodiment 360, wherein the peptide tag is an affinity tag, solubilization tag, chromatography tag, epitope or immunoepitope tag, or a fluorescence tag.

Embodiment 362. The method of embodiment 360, wherein the peptide tag is selected from the group consisting of: AviTag (SEQ ID NO: 245); C-tag (SEQ ID NO: 246); Calmodulin-tag (SEQ ID NO: 247); polyglutamate tag (SEQ ID NO: 248); E-tag (SEQ ID NO: 249); FLAG-tag (SEQ ID NO: 2); HA-tag (SEQ ID NO: 5); His-tag (SEQ ID NOs: 252-262); Myc-tag (SEQ ID NO: 6); NE-tag (SEQ ID NO: 264); Rho1D4-tag (SEQ ID NO: 265); S-tag (SEQ ID NO: 266); SBP-tag (SEQ ID NO: 267); Softag-1 (SEQ ID NO: 268); Softag-2 (SEQ ID NO: 269); Spot-tag (SEQ ID NO: 270); Strep-tag (SEQ ID NO: 271); TC tag (SEQ ID NO: 272); Ty tag (SEQ ID NO: 273); V5 tag (SEQ ID NO: 3); VSV-tag (SEQ ID NO: 275); and Xpress tag (SEQ ID NO: 276).

Embodiment 363. The method of embodiment 360, wherein the peptide tag is selected from the group consisting of: AU1 epitope (SEQ ID NO: 278); AU5 epitope (SEQ ID NO: 279); Bacteriophage T7 epitope (T7-tag) (SEQ ID NO: 280); Bluetongue virus tag (B-tag) (SEQ ID NO: 281); E2 epitope (SEQ ID NO: 282); Histidine affinity tag (HAT) (SEQ ID NO: 283); HSV epitope (SEQ ID NO: 284); Polyarginine (Arg-tag) (SEQ ID NO: 285); Polyaspartate (Asp-tag) (SEQ ID NO: 286); Polyphenylalanine (Phe-tag) (SEQ ID NO: 287); 51-tag (SEQ ID NO: 288); S-tag (SEQ ID NO: 266); and VSV-G (SEQ ID NO: 275).

Embodiment 364. The method of embodiment 359, wherein the functional moiety is an immunoepitope.

Embodiment 365. The method of embodiment 364, wherein the immunoepitope is selected from the group consisting of: tetanus toxoid (SEQ ID NO: 396); diphtheria toxin mutant CRM197 (SEQ ID NO: 630); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

Embodiment 366. The method of embodiment 359, wherein the functional moiety alters the localization of the protein of interest.

Embodiment 367. The method of embodiment 359, wherein the functional moiety is a degradation tag such that the degradation rate of the protein of interest is altered.

Embodiment 368. The method of embodiment 367, wherein the degradation tag results in the elimination of the tagged protein.

Embodiment 369. The method of embodiment 359, wherein the functional moiety is a small molecule binding domain.

Embodiment 370. The method of embodiment 359, wherein the small molecule binding domain is FKBP12 of SEQ ID NO: 488.

Embodiment 371. The method of embodiment 359, wherein the small molecule binding domain is FKBP12-F36V of SEQ ID NO: 489.

Embodiment 372. The method of embodiment 359, wherein the small molecule binding domain is cyclophilin of SEQ ID NOs: 490 and 493-494.

Embodiment 373. The method of embodiment 359, wherein the small molecule binding domain is installed in two or more proteins of interest.

Embodiment 374. The method of embodiment 373, wherein the two or more proteins of interest may dimerize upon contacting with a small molecule.

Embodiment 375. The method of embodiment 369, wherein the small molecule is a dimer of a small molecule selected from the group consisting of the compounds disclosed in Embodiment 163 of Group 1, above:

Embodiment 376. A method of installing an immunoepitope in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the immunoepitope.

Embodiment 377. The method of embodiment 376, wherein the immunoepitope is selected from the group consisting of: tetanus toxoid (SEQ ID NO: 396); diphtheria toxin mutant CRM197 (SEQ ID NO: 630); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); neuraminidase epitope H5N1-bound class I and class II HLA (SEQ ID NO: 426).

Embodiment 378. The method of embodiment 376, wherein the fusion protein comprises the amino acid sequence of PE1, PE2, or PE3.

Embodiment 379. The method of embodiment 376, wherein the napDNAbp is a Cas9 nickase (nCas9).

Embodiment 380. The method of embodiment 376, wherein the napDNAbp comprises the amino acid sequence of SEQ ID NOs: 18-88, 126, 130, 137, 141, 147, 153, 157, 445, 460, 467, and 482-487.

Embodiment 381. The method of embodiment 376, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 382. A method of installing a small molecule dimerization domain in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the small molecule dimerization domain; (b) polymerizing a single strand DNA sequence encoding the immunoepitope; and (c) incorporating the single strand DNA sequence in place of a corresponding endogenous strand at the target nucleotide sequence through a DNA repair and/or replication process, wherein the method produces a recombinant target nucleotide sequence that encodes a fusion protein comprising the protein of interest and the small molecule dimerization domain.

Embodiment 383. The method of embodiment 382, further comprising conducting the method on a second protein of interest.

Embodiment 384. The method of embodiment 383, wherein the first protein of interest and the second protein of interest dimerize in the presence of a small molecule that binds to the dimerization domain on each of said proteins.

Embodiment 385. The method of embodiment 382, wherein the small molecule binding domain is FKBP12 of SEQ ID NO: 488.

Embodiment 386. The method of embodiment 382, wherein the small molecule binding domain is FKBP12-F36V of SEQ ID NO: 489.

Embodiment 387. The method of embodiment 382, wherein the small molecule binding domain is cyclophilin of SEQ ID NOs: 490 and 493-494.

Embodiment 388. The method of embodiment 382, wherein the small molecule is a dimer of a small molecule selected from the group consisting of the compounds disclosed in Embodiment 163 of Group 1, above.

Embodiment 389. The method of embodiment 382, wherein the fusion protein comprises the amino acid sequence of PE1, PE2, or PE3.

Embodiment 390. The method of embodiment 382, wherein the napDNAbp is a Cas9 nickase (nCas9).

Embodiment 391. The method of embodiment 382, wherein the napDNAbp comprises the amino acid sequence of SEQ ID NOs: 18-88, 126, 130, 137, 141, 147, 153, 157, 445, 460, 467, and 482-487.

Embodiment 392. The method of embodiment 382, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 393. A method of installing a peptide tag or epitope onto a protein using prime editing, comprising: contacting a target nucleotide sequence encoding the protein with a prime editor construct configured to insert therein a second nucleotide sequence encoding the peptide tag to result in a recombinant nucleotide sequence, such that the peptide tag and the protein are expressed from the recombinant nucleotide sequence as a fusion protein.

Embodiment 394. The method of embodiment 383, wherein the peptide tag is used for purification and/or detection of the protein.

Embodiment 395. The method of embodiment 383, wherein the peptide tag is a poly-histidine (e.g., HHHHHH (SEQ ID NO: 252-262), FLAG (e.g., DYKDDDDK) (SEQ ID NO: 2), V5 (e.g., GKPIPNPLLGLDST) (SEQ ID NO: 3), GCN4, HA (e.g., YPYDVPDYA) (SEQ ID NO: 5), Myc (e.g. EQKLISEED) (SEQ ID NO: 6), or GST.

Embodiment 396. The method of embodiment 383, wherein the peptide tag has an amino acid sequence selected from the group consisting of SEQ ID NO: 1-6, 245-249, 252-262, 264-273, 275-276, 281, 278-288, and 622.

Embodiment 397. The method of embodiment 383, wherein the peptide tag is fused to the protein by a linker.

Embodiment 398. The method of embodiment 383, wherein the fusion protein has the following structure: [protein]-[peptide tag] or [peptide tag]-[protein], wherein "]-[" represents an optional linker.

Embodiment 399. The method of embodiment 383, wherein the linker has an amino acid sequence of SEQ ID NO: 127, 165-176, 446, 453, and 767-769.

Embodiment 400. The method of embodiment 383, wherein the prime editor construct comprises a PEgRNA comprising the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 401. The method of embodiment 383, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 402. The method of embodiment 383, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 403. A method of preventing or halting the progression of a prion disease by installing on or more protective mutations into PRNP encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety; (b) polymerizing a single strand DNA sequence encoding the protective mutation; and (c) incorporating the single strand DNA sequence in place of a corresponding endogenous strand at the target nucleotide sequence through a DNA repair and/or replication process, wherein the method produces a recombinant target nucleotide sequence that encodes a PRNP comprising a protective mutation and which is resistant to misfolding.

Embodiment 404. The method of embodiment 403, wherein the prion disease is a human prion disease.

Embodiment 405. The method of embodiment 403, wherein the prion disease is an animal prion disease.

Embodiment 406. The method of embodiment 404, wherein the prion disease is Creutzfeldt-Jakob Disease (CJD), Variant Creutzfeldt-Jakob Disease (vCJD), Gerstmann-Straussler-Scheinker Syndrome, Fatal Familial Insomnia, or Kuru.

Embodiment 407. The method of embodiment 403, wherein the prion disease is Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy.

Embodiment 408. The method of embodiment 403, wherein the wildtype PRNP amino acid sequence is SEQ ID NOs: 291-292.

Embodiment 409. The method of embodiment 403, wherein the method results in a modified PRNP amino acid sequence selected from the group consisting of SEQ ID NOs: 293-309, 311-323, wherein said modified PRNP protein is resistant to misfolding.

Embodiment 410. The method of embodiment 403, wherein the fusion protein comprises the amino acid sequence of PE1, PE2, or PE3.

Embodiment 411. The method of embodiment 403, wherein the napDNAbp is a Cas9 nickase (nCas9).

Embodiment 412. The method of embodiment 403, wherein the napDNAbp comprises the amino acid sequence of SEQ ID NOs: 18-88, 126, 130, 137, 141, 147, 153, 157, 445, 460, 467, and 482-487.

Embodiment 413. The method of embodiment 403, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 414. A method of installing a ribonucleotide motif or tag in an RNA of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the ribonucleotide motif or tag; (b) polymerizing a single strand DNA sequence encoding the ribonucleotide motif or tag; and (c) incorporating the single strand DNA sequence in place of a corresponding endogenous strand at the target nucleotide sequence through a DNA repair and/or replication process, wherein the method produces a recombinant target nucleotide sequence that encodes a modified RNA of interest comprising the ribonucleotide motif or tag.

Embodiment 415. The method of embodiment 414, wherein ribonucleotide motif or tag is a detection moiety.

Embodiment 416. The method of embodiment 414, wherein the ribonucleotide motif or tag affects the expression level of the RNA of interest.

Embodiment 417. The method of embodiment 414, wherein the ribonucleotide motif or tag affects the transport or subcellular location of the RNA of interest.

Embodiment 418. The method of embodiment 414, wherein the ribonucleotide motif or tag is selected from the group consisting of SV40 type 1, SV40 type 2, SV40 type 3, hGH, BGH, rbGlob, TK, MALAT1 ENE-mascRNA, KSHV PAN ENE, Smbox/U1 snRNA box, U1 snRNA 3' box, tRNA-lysine, broccoli aptamer, spinach aptamer, mango aptamer, HDV ribozyme, and m6A.

Embodiment 419. The method of embodiment 414, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 420. The method of embodiment 414, wherein the fusion protein comprises the amino acid sequence of PE1, PE2, or PE3.

Embodiment 421. The method of embodiment 414, wherein the napDNAbp is a Cas9 nickase (nCas9).

Embodiment 422. The method of embodiment 414, wherein the napDNAbp comprises the amino acid sequence of SEQ ID NOs: 18-88, 126, 130, 137, 141, 147, 153, 157, 445, 460, 467, and 482-487.

Embodiment 423. A method of installing or deleting a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety or deletion of same; (b) polymerizing a single strand DNA sequence encoding the functional moiety or deletion of same; and (c) incorporating the single strand DNA sequence in place of a corresponding endogenous strand at the target nucleotide sequence through a DNA repair and/or replication process, wherein the method produces a recombinant target nucleotide sequence that encodes a modified protein comprising the protein of interest and the functional moiety or the removal of same, wherein the functional moiety alters a modification state or localization state of the protein.

Embodiment 424. The method of embodiment 423, wherein functional moiety alters the phosphorylation, ubiquitylation, glycosylation, lipidation, hydroxylation, methylation, acetylation, crotonylation, SUMOylation state of the protein of interest.

Embodiment 425. A fusion protein comprising a nucleic acid programmable DNA binding protein (napDNAbp) domain and a domain comprising an RNA-dependent DNA polymerase activity.

Embodiment 426. The fusion protein of embodiment 425, wherein the fusion protein is capable of carrying out prime editing in the presence of an prime editing guide RNA (PEgRNA) to install a desired nucleotide change in a target sequence.

Embodiment 427. The fusion protein of embodiment 425, wherein the napDNAbp domain has a nickase activity.

Embodiment 428. The fusion protein of embodiment 425, wherein the napDNAbp domain is a Cas9 protein or variant thereof.

Embodiment 429. The fusion protein of embodiment 425, wherein the napDNAbp domain is a nuclease active Cas9, a nuclease inactive Cas9 (dCas9), or a Cas9 nickase (nCas9).

Embodiment 430. The fusion protein of embodiment 425, wherein the napDNAbp domain is Cas9 nickase (nCas9).

Embodiment 431. The fusion protein of embodiment 425, wherein the napDNAbp domain is selected from the group consisting of: Cas9, Cas12e, Cas12d, Cas12a, Cas12b1, Cas13a, Cas12c, and Argonaute and optionally has a nickase activity.

Embodiment 432. The fusion protein of embodiment 425, wherein the domain comprising an RNA-dependent DNA polymerase activity is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 433. The fusion protein of embodiment 425, wherein the domain comprising an RNA-dependent DNA polymerase activity is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766, and optionally wherein the domain comprising an RNA-dependent DNA polymerase is error-prone.

Embodiment 434. The fusion protein of embodiment 425, wherein the domain comprising an RNA-dependent DNA polymerase activity is a naturally-occurring reverse transcriptase from a retrovirus or a retrotransposon.

Embodiment 435. The fusion protein of embodiment 425, wherein the fusion protein when complexed with a PEgRNA is capable of binding to a target DNA sequence.

Embodiment 436. The fusion protein of embodiment 435, wherein the target DNA sequence comprises a target strand and a complementary non-target strand.

Embodiment 437. The fusion protein of embodiment 435, wherein the binding of the fusion protein complexed to the PEgRNA forms an R-loop.

Embodiment 438. The fusion protein of embodiment 437, wherein the R-loop comprises (i) an RNA-DNA hybrid comprising the PEgRNA and the target strand, and (ii) the complementary non-target strand.

Embodiment 439. The fusion protein of embodiment 437, wherein the target or the complementary non-target strand is nicked to form a priming sequence having a free 3' end.

Embodiment 440. The fusion protein of embodiment 439, wherein the nick site is upstream of the PAM sequence on the target strand.

Embodiment 441. The fusion protein of embodiment 439, wherein the nick site is upstream of the PAM sequence on the non-target strand.

Embodiment 442. The fusion protein of embodiment 439, wherein the nick site-1, -2, -3, -4, -5, -6, -7, -8, or -9 relative to the 5' end of the PAM sequence.

Embodiment 443. The fusion protein of embodiment 426, wherein the PEgRNA comprises a guide RNA and at least one nucleic acid extension arm.

Embodiment 444. The fusion protein of embodiment 443, wherein the extension arm is at the 5' or the 3' end of the guide RNA, or at an intramolecular location in the guide RNA.

Embodiment 445. The fusion protein of embodiment 443, wherein the extension arm comprises (i) a DNA synthesis template sequence comprising a desired nucleotide change, and (ii) a primer binding site.

Embodiment 446. The fusion protein of embodiment 445, wherein the DNA synthesis template sequence encodes a single-strand DNA flap that is complementary to an endogenous DNA sequence adjacent to the nick site, wherein the single-strand DNA flap comprises the desired nucleotide change.

Embodiment 447. The fusion protein of embodiment 443, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides, at least 26 nucleotides, at least 27 nucleotides, at least 28 nucleotides, at least 29 nucleotides, at least 30 nucleotides, at least 31 nucleotides, at least 32 nucleotides, at least 33 nucleotides, at least 34 nucleotides, at least 35 nucleotides, at least 36 nucleotides, at least 37 nucleotides, at least 38 nucleotides, at least 39 nucleotides, at least 40 nucleotides, at least 41 nucleotides, at least 42 nucleotides, at least 43 nucleotides, at least 44 nucleotides, at least 45 nucleotides, at least 46 nucleotides, at least 47 nucleotides, at least 48 nucleotides, at least 49 nucleotides, or at least 50 nucleotides.

Embodiment 448. The fusion protein of embodiment 443, wherein the single-strand DNA flap hybridizes to the endogenous DNA sequence adjacent to the nick site, thereby installing the desired nucleotide change in the target strand.

Embodiment 449. The fusion protein of embodiment 443, wherein the single-stranded DNA flap displaces the endogenous DNA sequence adjacent to the nick site and which has a free 5' end.

Embodiment 450. The fusion protein of embodiment 446, wherein the endogenous DNA sequence having the 5' end is excised by the cell.

Embodiment 451. The fusion protein of embodiment 446, wherein the endogenous DNA sequence having the 5' end is excised by a flap endonuclease.

Embodiment 452. The fusion protein of embodiment 448, wherein cellular repair of the single-strand DNA flap incorporates the desired nucleotide change in the non-target strand, thereby forming a desired product.

Embodiment 453. The fusion protein of embodiment 449, wherein the desired nucleotide change is installed in an editing window that is between about −4 to +10 of the PAM sequence, or between about −10 to +20 of the PAM sequence, or between about −20 to +40 of the PAM sequence, or between about −30 to +100 of the PAM sequence.

Embodiment 454. The fusion protein of embodiment 449, wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.

Embodiment 455. The fusion protein of embodiment 425, wherein the napDNAbp comprises an amino acid sequence of SEQ ID NO:18, or an amino acid sequence having at least 80%, 85%, 90%, 95%, 98%, or 99% sequence identity with the amino acid sequence to SEQ ID NO: 18.

Embodiment 456. The fusion protein of embodiment 425, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 457. The fusion protein of any one of the previous embodiments, wherein the fusion protein comprises the structure NH2-[napDNAbp]-[domain comprising an RNA-dependent DNA polymerase activity[-COOH; or NH2-[domain comprising an RNA-dependent DNA polymerase activity]-[napDNAbp]-COOH, wherein each instance of "]-[" indicates the presence of an optional linker sequence.

Embodiment 458. The fusion protein of embodiment 457, wherein the linker sequence comprises an amino acid sequence of SEQ ID NOs: 127, 165-176, 446, 453, and 767-769.

Embodiment 459. The fusion protein of embodiment 425, wherein the desired nucleotide change is a single nucleotide change, an insertion of one or more nucleotides, or a deletion of one or more nucleotides.

Embodiment 460. The fusion protein of embodiment 459, wherein the insert or deletion is at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, or at least 50.

Embodiment 461. A complex comprising a fusion protein of any of embodiments 425-460 and a PEgRNA, wherein the PEgRNA directs the fusion protein to a target DNA sequence for prime editing.

Embodiment 462. The complex of embodiment 461, wherein the PEgRNA comprises a guide RNA and a nucleic acid extension arm at the 3' or 5' end of the guide RNA or at an intramolecular position in the guide RNA.

Embodiment 463. The complex of embodiment 462, wherein the PEgRNA is capable of binding to a napDNAbp and directing the napDNAbp to the target DNA sequence.

Embodiment 464. The complex of embodiment 463, wherein the target DNA sequence comprises a target strand and a complementary non-target strand, wherein the guide RNA hybridizes to the target strand to form an RNA-DNA hybrid and an R-loop.

Embodiment 465. The complex of embodiment 464, wherein the at least one nucleic acid extension arm comprises (i) a DNA synthesis template, and (ii) a primer binding site.

Embodiment 466. The complex of embodiment 464, wherein the PEgRNA comprises the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 467. The complex of embodiment 465, wherein the DNA synthesis template comprises a nucleotide sequence that is at least 80%, or 85%, or 90%, or 95%, or 99% identical to the endogenous DNA target.

Embodiment 468. The complex of embodiment 465, wherein the primer binding site hybridizes with a free 3' end of the cut DNA.

Embodiment 469. The complex of embodiment 461, wherein the napDNAbp is a Cas9 nickase.

Embodiment 470. The complex of embodiment 461, wherein the napDNAbp comprises an amino acid sequence of SEQ ID NO: 18, or an amino acid sequence having at least 80%, 85%, 90%, 95%, 98%, or 99% sequence identity with SEQ ID NO: 18.

Embodiment 471. The complex of embodiment 461, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 472. The complex of embodiment 461, wherein the PEgRNA comprises a guide RNA and a nucleic acid extension arm at the 3' or 5' end of the guide RNA, or at an intramolecular position in the guide RNA.

Embodiment 473. The complex of embodiment 465, wherein the DNA synthesis template comprises a nucleotide sequence that is at least 80%, or 85%, or 90%, or 95%, or 99% identical to the endogenous DNA target.

Embodiment 474. The complex of embodiment 465, wherein the primer binding site hybridizes with a free 3' end of the cut DNA.

Embodiment 475. The complex of embodiment 462, wherein the PEgRNA further comprises at least one additional structure selected from the group consisting of a linker, a stem loop, a hairpin, a toeloop, an aptamer, or an RNA-protein recruitment domain.

Embodiment 476. A polynucleotide encoding the fusion protein of any of embodiments 425-461.

Embodiment 477. A polynucleotide encoding the PEgRNA of any of the above embodiments.

Embodiment 478. A vector comprising the polynucleotide of embodiment 476, wherein expression of the fusion protein is under the control of a promoter.

Embodiment 479. A vector comprising the polynucleotide of embodiment 477, wherein expression of the PEgRNA is under the control of a promoter.

Embodiment 480. The vector of embodiment 479, wherein the promoter is a U6 promoter.

Embodiment 481. The vector of embodiment 479, wherein the promoter is a CMV promoter.

Embodiment 482. The vector of embodiment 480, wherein the PEgRNA is engineered to remove one or more repeating clusters of Ts in the extension arm to improve transcription efficiency by the U6 promoter.

Embodiment 483. The vector of embodiment 482, wherein the one or more repeating clusters of Ts that is removed comprises at least 3 Ts, at least 4 Ts, at least 5 Ts, at least 6 Ts, at least 7 Ts, at least 8 Ts, at least 9 Ts, at least 10 Ts, at least 11 Ts, at least 12 Ts, at least 13 Ts, at least 14 Ts, at least 15 Ts, at least 16 Ts, at least 17 Ts, at least 18 Ts, at least 19 Ts, or at least 20 Ts.

Embodiment 484. A cell comprising the fusion protein of any of embodiments 425-460 and an PEgRNA bound to the napDNAbp of the fusion protein.

Embodiment 485. A cell comprising a complex of any one of embodiments 461-475.

Embodiment 486. A pharmaceutical composition comprising: (i) a fusion protein of any of embodiments 425-460, the complex of embodiments 461-475, the polynucleotide of embodiments 476-477, or the vector of embodiments 478-483; and (ii) a pharmaceutically acceptable excipient.

Embodiment 487. A pharmaceutical composition comprising: (i) the complex of embodiments 461-475 (ii) a polymerase provided in trans; and (iii) a pharmaceutically acceptable excipient.

Embodiment 488. A kit for prime editing comprising: (i) a nucleic acid molecule encoding the fusion protein of any one of embodiments 425-460; and (ii) a nucleic acid molecule encoding a PEgRNA that is capable of directing the fusion protein to a target DNA site, wherein the nucleic acid molecule of (i) and (ii) may be contained within a single DNA construct or separate DNA constructs.

Embodiment 489. The kit of embodiment 488, wherein the nucleic acid molecule of (i) further comprising a promoter that drives expression of the fusion protein.

Embodiment 490. The kit of embodiment 488, wherein the nucleic acid molecule of (ii) further comprises a promoter that drives expression of the PEgRNA.

Embodiment 491. The kit of embodiment 490, wherein the promoter is a U6 promoter.

Embodiment 492. The kit of embodiment 490, wherein the promoter is a CMV promoter.

Embodiment 493. The fusion protein of embodiment 457, wherein the linker sequence comprises an amino acid sequence of SEQ ID NOs: 174 (1×SGGS), 446 (2×SGGS), 3889 (3×SGGS), 171 (1×XTEN), 3968 (1×EAAAK), 3969 (2×EAAAK), and 3970 (3×EAAAK).

Group B. PE Guides and Methods of Design

Embodiment 1. A PEgRNA comprising a guide RNA and at least one nucleic acid extension arm comprising a DNA synthesis template.

Embodiment 2. The PEgRNA of embodiment 1, wherein the nucleic acid extension arm is position at the 3' or 5' end of the guide RNA, or at an intramolecular position in the guide RNA, and wherein the nucleic acid extension arm is DNA or RNA.

Embodiment 3. The PEgRNA of embodiment 1, wherein the PEgRNA is capable of binding to a napDNAbp and directing the napDNAbp to a target DNA sequence.

Embodiment 4. The PEgRNA of embodiment 3, wherein the target DNA sequence comprises a target strand and a complementary non-target strand.

Embodiment 5. The PEgRNA of embodiment 3, wherein the guide RNA hybridizes to the target strand to form an RNA-DNA hybrid and an R-loop.

Embodiment 6. The PEgRNA of embodiment 1, wherein the at least one nucleic acid extension arm further comprises a primer binding site.

Embodiment 7. The PEgRNA of embodiment 1, wherein the nucleic acid extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides, at least 26 nucleotides, at least 27 nucleotides, at least 28 nucleotides, at least 29 nucleotides, at least 30 nucleotides, at least 31 nucleotides, at least 32 nucleotides, at least 33 nucleotides, at least 34 nucleotides, at least 35 nucleotides, at least 36 nucleotides, at least 37 nucleotides, at least 38 nucleotides, at least 39 nucleotides, at least 40 nucleotides, at least 41 nucleotides, at least 42 nucleotides, at least 43 nucleotides, at least 44 nucleotides, at least 45 nucleotides, at least 46 nucleotides, at least 47 nucleotides, at least 48 nucleotides, at least 49 nucleotides, or at least 50 nucleotides.

Embodiment 8. The PEgRNA of embodiment 1, wherein the DNA synthesis template is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 9. The PEgRNA of embodiment 6, wherein the primer binding site is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 10. The PEgRNA of embodiment 1, further comprising at least one additional structure selected from the group consisting of a tRNA, linker, a stem loop, a hairpin, a toeloop, an aptamer, or an RNA-protein recruitment domain.

Embodiment 11. The PEgRNA of embodiment 1, wherein the DNA synthesis template encodes a single-strand DNA flap that is complementary to an endogenous DNA sequence adjacent to a nick site, wherein the single-strand DNA flap comprises a desired nucleotide change.

Embodiment 12. The PEgRNA of embodiment 11, wherein the single-stranded DNA flap displaces an endogenous single-strand DNA having a 5' end in the target DNA sequence that has been nicked, and wherein the endogenous single-strand DNA is immediately adjacent downstream of the nick site.

Embodiment 13. The PEgRNA of embodiment 11, wherein the endogenous single-stranded DNA having the free 5' end is excised by the cell.

Embodiment 14. The PEgRNA of embodiment 13, wherein cellular repair of the single-strand DNA flap results in installation of the desired nucleotide change, thereby forming a desired product.

Embodiment 15. The PEgRNA of embodiment 1, comprising the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 16. The PEgRNA of embodiment 1, wherein the DNA synthesis template comprises a nucleotide sequence that is at least 80%, or 85%, or 90%, or 95%, or 99% identical to the endogenous DNA target.

Embodiment 17. The PEgRNA of embodiment 6, wherein the primer binding site hybridizes with a free 3' end of the cut DNA.

Embodiment 18. The PEgRNA of embodiment 10, wherein the at least one additional structure is located at the 3' or 5' end of the PEgRNA.

Embodiment 19. The PEgRNA of embodiment 10, wherein the linker comprises a nucleotide sequence selected from the group consisting of SEQ ID NOs: 127, 165-176, 446, 453, and 767-769.

Embodiment 20. The PEgRNA of embodiment 10, wherein the stem loop comprises a nucleotide sequence selected from the stem loops described herein.

Embodiment 21. The PEgRNA of embodiment 10, wherein the hairpin comprises a nucleotide sequence selected from the hairpins described herein.

Embodiment 22. The PEgRNA of embodiment 10, wherein the toeloop comprises a nucleotide sequence selected from the toeloops described herein.

Embodiment 23. The PEgRNA of embodiment 10, wherein the aptamer comprises a nucleotide sequence selected from the aptamers described herein.

Embodiment 24. The PEgRNA of embodiment 10, wherein the RNA-protein recruitment domain comprises a nucleotide sequence selected from the RNA-protein recruitment domain described herein.

Embodiment 25. A method for designing a PEgRNA for use in prime editing to install a desired nucleotide change in a target nucleotide sequence, wherein said PEgRNA comprises a spacer, gRNA core, and an extension arm, and wherein said extension arm comprises a primer binding site and a DNA synthesis template, said method comprising:
  (i) selecting a desired target edit site in a target nucleotide sequence;
  (ii) obtaining a context nucleotide sequence upstream and downstream from the target edit site;
  (iii) locating putative protospacer adjacent motif (PAM) sites in the context nucleotide sequence which are proximal to the desired target edit site;
  (iv) identifying the corresponding nick sites for each putative PAM site;
  (v) designing the spacer;
  (vi) designing the gRNA core;
  (vii) designing the extension arm; and
  (viii) constructing the full PEgRNA by concatenating the spacer, gRNA core, and the extension arm.

Embodiment 26. The method of embodiment 25, wherein the step (i) of selecting the desired target edit site comprises selecting a disease-causing mutation.

Embodiment 27. The method of embodiment 26, wherein the disease-causing mutation is associated with a disease selected from the group consisting of: cancer, autoimmune disorders, neurological disorders, skin disorders, respiratory diseases, and cardiac diseases.

Embodiment 28. The method of embodiment 25, wherein the step (ii) of obtaining a context nucleotide sequence upstream and downstream from the target edit site comprises obtaining about 50-55 base pairs (bp), about 55-60 bp, about 60-65 bp, about 65-70 bp, about 70-75 bp, about 75-80 bp, about 80-85 bp, about 85-90 bp, about 90-95 bp, about 95-100 bp, about 100-105 bp, about 105-110 bp, about 110-125 bp, about 125-130 bp, about 130-135 bp, about 135-140 bp, about 140-145 bp, about 145-150 bp, about 150-155 bp, about 155-160 bp, about 160-165 bp, about 165-170 bp, about 170-175 bp, about 175-180 bp, about 180-185 bp, about 185-190 bp, about 190-195 bp, about 195-200 bp, about 200-205 bp, about 205-210 bp, about 210-215 bp, about 215-220 bp, about 220-225 bp, about 225-230 bp, about 230-235 bp, about 235-240 bp, about 240-245 bp, or about 245-250 bp of a region that comprises the desired target edit site.

Embodiment 29. The method of embodiment 28, wherein the desired target edit site is positioned approximately equidistant from each end of the context nucleotide sequence.

Embodiment 30. The method of embodiment 25, wherein in step (iii), the putative PAM sites are proximal to the desired target edit site.

Embodiment 31. The method of embodiment 25, wherein in step (iii), the putative PAM sites comprise those with associated nick sites located at a position less than 30 nucleotides from the target edit site, or less than 29, 28, 27, 26, 25, 24, 23, 22, 21, 20, 19, 18, 17, 16, 15, 14, 13, 12, 11, 10, 9, 8, 7, 6, 5, 4, 3, or 2 nucleotides from the target edit site.

Embodiment 32. The method of embodiment 25, wherein in step (iii), the putative PAM sites comprise those with associated nick sites located at a position more than 30 nucleotides from the target edit site, or more than 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84,85, 86, 87, 88, 89, 90, 91, 92, 93, 94, 95, 96, 97, 98, 99, or 100 nucleotides from the target edit site.

Embodiment 33. The method of embodiment 25, wherein in step (iii), the putative PAM sites are associated with one or corresponding napDNAbp which bind to said PAM sites.

Embodiment 34. The method of embodiment 33, the putative PAM sites and their corresponding napDNAbps are selected from any of the following groupings: (a) SpCas9 of SEQ ID NO: 18-25 and 87-88 and NGG; (b) Sp VQR nCas9; and (c) NGAN.

Embodiment 35. The method of embodiment 25, wherein the step (v) of designing the spacer comprises determining the complement nucleotide sequence of the protospacer sequence associated with each putative PAM.

Embodiment 36. The method of embodiment 25, wherein the step (vi) of designing gRNA core comprises in the context of each putative PAM, selecting a gRNA core sequence that is capable of binding to a napDNAbp which is associated with each of said putative PAMs.

Embodiment 37. The method of embodiment 25, wherein the step (vii) of designing the extension arm comprises designing (a) a DNA synthesis template comprising the edit of interest, and (b) a primer binding site.

Embodiment 38. The method of embodiment 37, wherein designing the primer binding site comprises (a) identifying a DNA primer on the PAM-containing strand of the target nucleotide sequence, wherein the 3' end of the DNA primer is the first nucleotide upstream of the nick site associated with the PAM site, and (b) designing the complement of the DNA primer, wherein said complement forms the the primer binding site.

Embodiment 39. The method of embodiment 38, wherein the primer binding site is 8 to 15 nucleotides in length.

Embodiment 40. The method of embodiment 38, wherein the primer binding site is 12-13 nucleotides if the DNA primer contains about 40-60% GC content.

Embodiment 41. The method of embodiment 38, wherein the primer binding site is 14-15 nucleotides if the DNA primer contains less than about 40% GC content.

Embodiment 42. The method of embodiment 38, wherein the primer binding site is 8-11 nucleotides if the DNA primer contains greater than about 60% GC content.

Embodiment 43. A method of prime editing comprising contacting a target DNA sequence with a PEgRNA of any of embodiments 1-24 and a prime editor fusion protein comprising a napDNAbp and a domain having an RNA-dependent DNA polymerase activity.

Embodiment 44. The method of embodiment 43, wherein the napDNAbp has a nickase activity.

Embodiment 45. The method of embodiment 43, wherein the napDNAbp is a Cas9 protein or variant thereof.

Embodiment 46. The method of embodiment 43, wherein the napDNAbp is a nuclease active Cas9, a nuclease inactive Cas9 (dCas9), or a Cas9 nickase (nCas9).

Embodiment 47. The method of embodiment 43, wherein the napDNAbp is Cas9 nickase (nCas9).

Embodiment 48. The method of embodiment 43, wherein the napDNAbp is selected from the group consisting of: Cas9, Cas12e, Cas12d, Cas12a, Cas12b1, Cas13a, Cas12c, and Argonaute and optionally has a nickase activity.

Embodiment 49. The method of embodiment 43, wherein the domain comprising an RNA-dependent DNA polymerase activity is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 50. The method of embodiment 43, wherein the domain comprising an RNA-dependent DNA polymerase activity is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 51. The method of embodiment 43, wherein the domain comprising an RNA-dependent DNA polymerase activity is a naturally-occurring reverse transcriptase from a retrovirus or a retrotransposon.

Group C. PE Complexes

Embodiment 1. A complex for prime editing comprising:
(i) fusion protein comprising a nucleic acid programmable DNA binding protein (napDNAbp) and a domain comprising an RNA-dependent DNA polymerase activity; and
(ii) a prime editing guide RNA (PEgRNA).

Embodiment 2. The complex of embodiment 1, wherein the fusion protein is capable of carrying out prime editing in the presence of the prime editing guide RNA (PEgRNA) to install a desired nucleotide change in a target sequence.

Embodiment 3. The complex of embodiment 11, wherein the napDNAbp has a nickase activity.

Embodiment 4. The complex of embodiment 1, wherein the napDNAbp is a Cas9 protein or variant thereof.

Embodiment 5. The complex of embodiment 1, wherein the napDNAbp is a nuclease active Cas9, a nuclease inactive Cas9 (dCas9), or a Cas9 nickase (nCas9).

Embodiment 6. The complex of embodiment 1, wherein the napDNAbp is Cas9 nickase (nCas9).

Embodiment 7. The complex of embodiment 1, wherein the napDNAbp is selected from the group consisting of: Cas9, Cas12e, Cas12d, Cas12a, Cas12b1, Cas13a, Cas12c, and Argonaute and optionally has a nickase activity.

Embodiment 8. The complex of embodiment 1, wherein the domain comprising an RNA-dependent DNA polymerase activity is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 9. The complex of embodiment 1, wherein the domain comprising an RNA-dependent DNA polymerase activity is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 10. The complex of embodiment 1, wherein the domain comprising an RNA-dependent DNA polymerase activity is a naturally-occurring reverse transcriptase from a retrovirus or a retrotransposon.

Embodiment 11. The complex of embodiment 1, wherein the fusion protein when complexed with a PEgRNA is capable of binding to a target DNA sequence.

Embodiment 12. The complex of embodiment 1, wherein the PEgRNA comprises a guide RNA and at least one nucleic acid extension arm comprising a DNA synthesis template.

Embodiment 13. The complex of embodiment 12, wherein the nucleic acid extension arm is position at the 3' or 5' end of the guide RNA, or at an intramolecular position in the guide RNA, and wherein the nucleic acid extension arm is DNA or RNA.

Embodiment 14. The complex of embodiment 12, wherein the PEgRNA is capable of binding to a napDNAbp and directing the napDNAbp to a target DNA sequence.

Embodiment 15. The complex of embodiment 14, wherein the target DNA sequence comprises a target strand and a complementary non-target strand.

Embodiment 16. The complex of embodiment 12, wherein the guide RNA hybridizes to the target strand to form an RNA-DNA hybrid and an R-loop.

Embodiment 17. The complex of embodiment 12, wherein the at least one nucleic acid extension arm further comprises a primer binding site.

Embodiment 18. The complex of embodiment 12, wherein the nucleic acid extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, at least 25 nucleotides, at least 26 nucleotides, at least 27 nucleotides, at least 28 nucleotides, at least 29 nucleotides, at least 30 nucleotides, at least 31 nucleotides, at least 32 nucleotides, at least 33 nucleotides, at least 34 nucleotides, at least 35 nucleotides, at least 36 nucleotides, at least 37 nucleotides, at least 38 nucleotides, at least 39 nucleotides, at least 40 nucleotides, at least 41 nucleotides, at least 42 nucleotides, at least 43 nucleotides, at least 44 nucleotides, at least 45 nucleotides, at least 46 nucleotides, at least 47 nucleotides, at least 48 nucleotides, at least 49 nucleotides, or at least 50 nucleotides.

Embodiment 19. The complex of embodiment 12, wherein the DNA synthesis template is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 20. The complex of embodiment 17, wherein the primer binding site is at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, or at least 15 nucleotides in length.

Embodiment 21. The complex of embodiment 12, wherein the PEgRNA further comprises at least one additional structure selected from the group consisting of a linker, a stem loop, a hairpin, a toeloop, an aptamer, or an RNA-protein recruitment domain.

Embodiment 22. The complex of embodiment 12, wherein the DNA synthesis template encodes a single-strand DNA flap that is complementary to an endogenous DNA sequence adjacent to a nick site, wherein the single-strand DNA flap comprises a desired nucleotide change.

Embodiment 23. The complex of embodiment 22, wherein the single-stranded DNA flap displaces an endogenous single-strand DNA having a 5' end in the target DNA sequence that has been nicked, and wherein the endogenous single-strand DNA is immediately adjacent downstream of the nick site.

Embodiment 24. The complex of embodiment 23, wherein the endogenous single-stranded DNA having the free 5' end is excised by the cell.

Embodiment 25. The complex of embodiment 23, wherein cellular repair of the single-strand DNA flap results in installation of the desired nucleotide change, thereby forming a desired product.

Embodiment 26. The complex of embodiment 12, wherein the PEgRNA comprises the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or a nucleotide sequence having at least 85%, or at least 90%, or at least 95%, or at least 98%, or at least 99% sequence identity with any one of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 27. The complex of embodiment 12, wherein the DNA synthesis template comprises a nucleotide sequence that is at least 80%, or 85%, or 90%, or 95%, or 99% identical to the endogenous DNA target.

Embodiment 28. The complex of embodiment 17, wherein the primer binding site hybridizes with a free 3' end of the cut DNA.

Embodiment 29. The complex of embodiment 21, wherein the at least one additional structure is located at the 3' or 5' end of the PEgRNA.

Embodiment 30. The complex of embodiment 29, wherein the linker comprises a nucleotide sequence selected from the group consisting of SEQ ID NOs: 127, 165-176, 446, 453, and 767-769.

Embodiment 31. The complex of embodiment 29, wherein the stem loop comprises a nucleotide sequence selected from the stem loops described herein.

Embodiment 32. The complex of embodiment 29, wherein the hairpin comprises a nucleotide sequence selected from the hairpins described herein.

Embodiment 33. The complex of embodiment 29, wherein the toeloop comprises a nucleotide sequence selected from the toeloops described herein.

Embodiment 34. The complex of embodiment 29, wherein the aptamer comprises a nucleotide sequence selected from the aptamers described herein.

Embodiment 35. The complex of embodiment 29, wherein the RNA-protein recruitment domain comprises a nucleotide sequence selected from the RNA-protein recruitment domains described herein.

Embodiment 36. The complex of embodiment 1, wherein the target DNA sequence comprises a target strand and a complementary non-target strand.

Embodiment 37. The complex of embodiment 36, wherein the R-loop comprises (i) an RNA-DNA hybrid comprising the PEgRNA and the target strand, and (ii) the complementary non-target strand.

Embodiment 38. The complex of embodiment 37, wherein the target or the complementary non-target strand is nicked to form a priming sequence having a free 3' end.

Embodiment 39. The complex of embodiment 38, wherein the nick site is upstream of the PAM sequence on the target strand.

Embodiment 40. The complex of embodiment 38, wherein the nick site is upstream of the PAM sequence on the non-target strand.

Embodiment 41. The complex of embodiment 38, wherein the nick site –1, –2, –3, –4, –5, –6, –7, –8, or –9 relative to the 5' end of the PAM sequence.

Embodiment 42. The complex of embodiment 22, wherein the single-strand DNA flap hybridizes to the endogenous DNA sequence adjacent to the nick site, thereby installing the desired nucleotide change in the target strand.

Embodiment 43. The complex of embodiment 22, wherein the single-stranded DNA flap displaces the endogenous DNA sequence adjacent to the nick site and which has a free 5' end.

Embodiment 44. The complex of embodiment 22, wherein the endogenous DNA sequence having the 5' end is excised by the cell.

Embodiment 45. The complex of embodiment 44, wherein the endogenous DNA sequence having the 5' end is excised by a flap endonuclease.

Embodiment 46. The complex of embodiment 43, wherein cellular repair of the single-strand DNA flap incorporates the desired nucleotide change in the non-target strand, thereby forming a desired product.

Embodiment 47. The complex of embodiment 46, wherein the desired nucleotide change is installed in an editing window that is between about –4 to +10 of the PAM sequence, or between about –10 to +20 of the PAM sequence, or between about –20 to +40 of the PAM sequence, or between about –30 to +100 of the PAM sequence.

Embodiment 48. The complex of embodiment 47, wherein the desired nucleotide change is installed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides downstream of the nick site.

Embodiment 49. The complex of any one of the previous embodiments, wherein the fusion protein comprises the structure NH2-[napDNAbp]-[domain comprising an RNA-dependent DNA polymerase activity[-COOH; or NH2-[domain comprising an RNA-dependent DNA polymerase activity]-[napDNAbp]-COOH, wherein each instance of "]-[" indicates the presence of an optional linker sequence.

Embodiment 50. The complex of embodiment 49, wherein the linker sequence comprises an amino acid sequence of SEQ ID NOs: 127, 165-176, 446, 453, and 767-769.

Embodiment 51. The complex of embodiment 1, wherein the fusion protein further comprises a linker that joins the napDNAbp and the domain comprising an RNA-dependent DNA polymerase activity.

Embodiment 52. complex of embodiment 51, wherein the linker sequence comprises an amino acid sequence of SEQ ID NOs. 174 (1×SGGS), 446 (2×SGGS), 3889 (3×SGGS), 171 (1×XTEN), 3968 (1×EAAAK), 3969 (2×EAAAK), and 3970 (3× EAAAK).

Group D. PE Method for Correcting Mutations

Embodiment 1. A method for installing a desired nucleotide change in a double-stranded DNA sequence, the method comprising: contacting the double-stranded DNA sequence with a complex comprising a fusion protein and a PEgRNA, wherein the fusion protein comprises a napDNAbp and a polymerase, and wherein the PEgRNA comprises a DNA synthesis template comprising the desired nucleotide change and a primer binding site;
thereby nicking the double-stranded DNA sequence, thereby generating a free single-strand DNA having a 3' end;
thereby hybridizing the 3' end of the free single-strand DNA to the primer binding site, thereby priming the polymerase;
thereby polymerizing a strand of DNA from the 3' end hybridized to the primer binding site, thereby generating a single-strand DNA flap comprising the desired nucleotide change and which is complementary to the DNA synthesis template;
thereby replacing an endogenous DNA strand adjacent the cut site with the single-strand DNA flap, thereby installing the desired nucleotide change in the double-stranded DNA sequence.

Embodiment 2. The method of embodiment 1, wherein replacing an endogenous DNA strand comprises: (i) hybridizing the single-strand DNA flap to the endogenous DNA strand adjacent the cut site to create a sequence mismatch; (ii) excising the endogenous DNA strand; and (iii) repairing the mismatch to form the desired product comprising the desired nucleotide change in both strands of DNA.

Embodiment 3. The method of embodiment 1, wherein the desired nucleotide change is a single nucleotide substitution, a deletion, or an insertion.

Embodiment 4. The method of embodiment 3, wherein the single nucleotide substitution is a transition or a transversion.

Embodiment 5. The method of embodiment 1, wherein the desired nucleotide change is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

Embodiment 6. The method of embodiment 1, wherein the desired nucleotide change converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, a C:G basepair to an A:T basepair, (10) an A:T basepair to a T:A basepair, (11) an A:T basepair to a G:C basepair, or (12) an A:T basepair to a C:G basepair.

Embodiment 7. The method of embodiment 1, wherein the desired nucleotide change is an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 8. The method of embodiment 1, wherein the desired nucleotide change corrects a disease-associated gene.

Embodiment 9. The method of embodiment 8, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

Embodiment 10. The method of embodiment 8, wherein the disease-associated gene is associated with a polygenic disorder selected from the group consisting of: heart disease; high blood pressure; Alzheimer's disease; arthritis; diabetes; cancer; and obesity.

Embodiment 11. The method of embodiment 1, wherein the napDNAbp is a nuclease dead Cas9 (dCas9), a Cas9 nickase (nCas9), or a nuclease active Cas9.

Embodiment 12. The method of embodiment 1, wherein the napDNAbp comprises an amino acid sequence of SEQ ID NO: 18.

Embodiment 13. The method of embodiment 1, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 14. The method of embodiment 1, wherein the polymerase is a reverse transcriptase comprising any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 15. The method of embodiment 1, wherein the polymerase is a reverse transcriptase comprising an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 16. The method of embodiment 1, wherein the PEgRNA comprises a nucleic acid extension arm at the 3' or 5' ends or at an intramolecular location in the guide RNA, wherein the extension arm comprises the DNA synthesis template sequence and the primer binding site.

Embodiment 17. The method of embodiment 16, wherein the extension arm is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides in length.

Embodiment 18. The method of embodiment 1, wherein the PEgRNA has a nucleotide sequence selected from the group consisting of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 19. A method for introducing one or more changes in the nucleotide sequence of a DNA molecule at a target locus, comprising: contacting the DNA molecule with a nucleic acid programmable DNA binding protein (napDNAbp) and a PEgRNA which targets the napDNAbp to the target locus, wherein the PEgRNA comprises a reverse transcriptase (RT) template sequence comprising at least one desired nucleotide change and a primer binding site;

thereby forming an exposed 3' end in a DNA strand at the target locus;

thereby hybridizing the exposed 3' end to the primer binding site to prime reverse transcription;

thereby synthesizing a single strand DNA flap comprising the at least one desired nucleotide change based on the RT template sequence by reverse transcriptase;

thereby incorporating the at least one desired nucleotide change into the corresponding endogenous DNA, thereby introducing one or more changes in the nucleotide sequence of the DNA molecule at the target locus.

Embodiment 20. The method of embodiment 19, wherein the one or more changes in the nucleotide sequence comprises a transition.

Embodiment 21. The method of embodiment 19, wherein the transition is selected from the group consisting of: (a) T to C; (b) A to G; (c) C to T; and (d) G to A.

Embodiment 22. The method of embodiment 19, wherein the one or more changes in the nucleotide sequence comprises a transversion.

Embodiment 23. The method of embodiment 22, wherein the transversion is selected from the group consisting of: (a) T to A; (b) T to G; (c) C to G; (d) C to A; (e) A to T; (f) A to C; (g) G to C; and (h) G to T.

Embodiment 24. The method of embodiment 19, wherein the one or more changes in the nucleotide sequence comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (9) an A:T basepair to a T:A basepair, (11) an A:T basepair to a G:C basepair, or (12) an A:T basepair to a C:G basepair.

Embodiment 25. The method of embodiment 19, wherein the one or more changes in the nucleotide sequence comprises an insertion or deletion of 1, 2, 3, 4, 5, 6, 7, 8, 9, 10, 11, 12, 13, 14, 15, 16, 17, 18, 19, 20, 21, 22, 23, 24, or 25 nucleotides.

Embodiment 26. The method of embodiment 19, wherein the one or more changes in the nucleotide sequence comprises a correction to a disease-associated gene.

Embodiment 27. The method of embodiment 26, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

Embodiment 28. The method of embodiment 26, wherein the disease-associated gene is associated with a polygenic disorder selected from the group consisting of: heart disease; high blood pressure; Alzheimer's disease; arthritis; diabetes; cancer; and obesity.

Embodiment 29. The method of embodiment 19, wherein the napDNAbp is a nuclease active Cas9 or variant thereof.

Embodiment 30. The method of embodiment 19, wherein the napDNAbp is a nuclease inactive Cas9 (dCas9) or Cas9 nickase (nCas9), or a variant thereof.

Embodiment 31. The method of embodiment 19, wherein the napDNAbp comprises an amino acid sequence of SEQ ID NO: 18.

Embodiment 32. The method of embodiment 19, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 33. The method of embodiment 19, wherein the reverse transcriptase is introduced in trans.

Embodiment 34. The method of embodiment 19, wherein the napDNAbp comprises a fusion to a reverse transcriptase.

Embodiment 35. The method of embodiment 19, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 36. The method of embodiment 19, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 37. The method of embodiment 19, wherein the step of forming an exposed 3' end in the DNA strand at the target locus comprises nicking the DNA strand with a nuclease.

Embodiment 38. The method of embodiment 37, wherein the nuclease is the napDNAbp, is provided as a fusion domain of napDNAbp, or is provided in trans.

Embodiment 39. The method of embodiment 19, wherein the step of forming an exposed 3' end in the DNA strand at the target locus comprises contacting the DNA strand with a chemical agent.

Embodiment 40. The method of embodiment 19, wherein the step of forming an exposed 3' end in the DNA strand at the target locus comprises introducing a replication error.

Embodiment 41. The method of embodiment 19, wherein the step of contacting the DNA molecule with the napDNAbp and the guide RNA forms an R-loop.

Embodiment 42. The method of embodiment 41, wherein the DNA strand in which the exposed 3' end is formed is in the R-loop.

Embodiment 43. The method of embodiment 19, wherein the PEgRNA comprises an extension arm that comprises the reverse transcriptase (RT) template sequence and the primer binding site.

Embodiment 44. The method of embodiment 43, wherein the extension arm is at the 3' end of the guide RNA, the 5' end of the guide RNA, or at an intramolecular position in the guide RNA.

Embodiment 45. The method of embodiment 19, wherein the PEgRNA further comprises at least one additional structure selected from the group consisting of a linker, a stem loop, a hairpin, a toeloop, an aptamer, or an RNA-protein recruitment domain.

Embodiment 46. The method of embodiment 19, wherein the PEgRNA further comprises a homology arm.

Embodiment 47. The method of embodiment 19, wherein the RT template sequence is homologous to the corresponding endogenous DNA.

Embodiment 48. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change;

thereby conducting target-primed reverse transcription of the RT template to generate a single strand DNA comprising the desired nucleotide change;

thereby incorporating the desired nucleotide change into the DNA molecule at the target locus through a DNA repair and/or replication process.

Embodiment 49. The method of embodiment 48, wherein the RT template is located at the 3' end of the guide RNA, the 5' end of the guide RNA, or at an intramolecular location in the guide RNA.

Embodiment 50. The method of embodiment 48, wherein the desired nucleotide change comprises a transition, a transversion, an insertion, or a deletion, or any combination thereof.

Embodiment 51. The method of embodiment 48, wherein the desired nucleotide change comprises a transition selected from the group consisting of: (a) T to C; (b) A to G; (c) C to T; and (d) G to A.

Embodiment 52. The method of embodiment 48, wherein the desired nucleotide change comprises a transversion selected from the group consisting of: (a) T to A; (b) T to G; (c) C to G; (d) C to A; (e) A to T; (f) A to C; (g) G to C; and (h) G to T.

Embodiment 53. The method of embodiment 48, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 54. A method for replacing a trinucleotide repeat expansion mutation in a target DNA molecule with a healthy sequence comprising a healthy number of repeat trinucleotides, the method comprising: (a) contacting the DNA molecule at the target locus with a (i) fusion protein comprising a nucleic acid programmable DNA binding protein (napDNAbp) and a polymerase and (ii) a PEgRNA comprising DNA synthesis template comprising the replacement sequence and a primer binding site; (b) conducting prime editing to generate a single strand DNA comprising the replacement sequence; and (c) incorporating the single strand DNA into the DNA molecule at the target locus through a DNA repair and/or replication process.

Embodiment 55. The method of embodiment 54, wherein the fusion protein comprises the amino acid sequence of PE1, PE2, or PE3.

Embodiment 56. The method of embodiment 54, wherein the napDNAbp is a Cas9 nickase (nCas9).

Embodiment 57. The method of embodiment 54, wherein the napDNAbp comprises the amino acid sequence of SEQ ID NOs: 18-88, 126, 130, 137, 141, 147, 153, 157, 445, 460, 467, and 482-487.

Embodiment 58. The method of embodiment 54, wherein the guide RNA comprises SEQ ID NO: 222.

Embodiment 59. The method of embodiment 54, wherein the step of (b) conducting prime editing comprises generating a 3' end primer binding sequence at the target locus that is capable of priming polymerase by annealing to the primer binding site on the guide RNA.

Embodiment 60. The method of embodiment 54, wherein the trinucleotide repeat expansion mutation is associated with Huntington's Disease, Fragile X syndrome, or Friedreich's ataxia.

Embodiment 61. The method of embodiment 54, wherein the trinucleotide repeat expansion mutation comprises a repeating unit of CAG triplets.

Embodiment 62. The method of embodiment 54, wherein the trinucleotide repeat expansion mutation comprises a repeating unit of GAA triplets.

Embodiment 63. A method for introducing one or more changes in the nucleotide sequence of a DNA molecule at a target locus by target-primed reverse transcription, the method comprising: (a) contacting the DNA molecule at the target locus with a (i) fusion protein comprising a nucleic acid programmable DNA binding protein (napDNAbp) and a reverse transcriptase and (ii) a guide RNA comprising an RT template comprising a desired nucleotide change;

thereby conducting target-primed reverse transcription of the RT template to generate a single strand DNA comprising the desired nucleotide change;

thereby incorporating the desired nucleotide change into the DNA molecule at the target locus through a DNA repair and/or replication process.

Embodiment 64. The method of embodiment 63, wherein the RT template is located at the 3' end of the guide RNA, the 5' end of the guide RNA, or at an intramolecular location in the guide RNA.

Embodiment 65. The method of embodiment 63, wherein the desired nucleotide change comprises a transition, a transversion, an insertion, or a deletion, or any combination thereof.

Embodiment 66. The method of embodiment 63, wherein the desired nucleotide change comprises a transition selected from the group consisting of: (a) T to C; (b) A to G; (c) C to T; and (d) G to A.

Embodiment 67. The method of embodiment 63, wherein the desired nucleotide change comprises a transversion selected from the group consisting of: (a) T to A; (b) T to G; (c) C to G; (d) C to A; (e) A to T; (f) A to C; (g) G to C; and (h) G to T.

Embodiment 68. The method of embodiment 63, wherein the desired nucleotide change comprises changing (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 69. A method of preventing or halting the progression of a prion disease by installing on or more protective mutations into PRNP encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety;

thereby polymerizing a single strand DNA sequence encoding the protective mutation;

thereby incorporating the single strand DNA sequence in place of a corresponding endogenous strand at the target nucleotide sequence through a DNA repair and/or replication process;

wherein the method produces a recombinant target nucleotide sequence that encodes a PRNP comprising a protective mutation and which is resistant to misfolding.

Embodiment 70. The method of embodiment 69, wherein the prion disease is a human prion disease.

Embodiment 71. The method of embodiment 69, wherein the prion disease is an animal prion disease.

Embodiment 72. The method of embodiment 69, wherein the prion disease is Creutzfeldt-Jakob Disease (CJD), Variant Creutzfeldt-Jakob Disease (vCJD), Gerstmann-Straussler-Scheinker Syndrome, Fatal Familial Insomnia, or Kuru.

Embodiment 73. The method of embodiment 69, wherein the prion disease is Bovine Spongiform Encephalopathy (BSE or "mad cow disease"), Chronic Wasting Disease (CWD), Scrapie, Transmissible Mink Encephalopathy, Feline Spongiform Encephalopathy, and Ungulate Spongiform Encephalopathy.

Embodiment 74. The method of embodiment 69, wherein the wildtype PRNP amino acid sequence is SEQ ID NOs: 291-292.

Embodiment 75. The method of embodiment 69, wherein the method results in a modified PRNP amino acid sequence selected from the group consisting of SEQ ID NOs: 293-309, 311-323, wherein said modified PRNP protein is resistant to misfolding.

Embodiment 76. The method of embodiment 69, wherein the fusion protein comprises the amino acid sequence of PE1, PE2, or PE3.

Embodiment 77. The method of embodiment 69, wherein the napDNAbp is a Cas9 nickase (nCas9).

Embodiment 78. The method of embodiment 69, wherein the napDNAbp comprises the amino acid sequence of SEQ ID NOs: 18-88, 126, 130, 137, 141, 147, 153, 157, 445, 460, 467, and 482-487.

Embodiment 79. The method of embodiment 69, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 80. A method of treating CDKL5 Deficiency Disorder by correcting a mutation in the cyclin-dependent kinase-like 5 gene (CDKL5) in a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template that corrects the mutation in CDKL5;

thereby polymerizing a single strand DNA sequence encoding the edit;

thereby incorporating the single strand DNA sequence in place of a corresponding endogenous strand at the target nucleotide sequence through a DNA repair and/or replication process;

wherein the method produces a recombinant target nucleotide sequence that encodes a repaired CDKL5 gene.

Embodiment 81. The method of embodiment D80, wherein the mutation in CDKL5 is 1412delA.

Group E. PE Methods for Modifying Protein Structure/Function and/or Mutagenesis Embodiment 1. A method for mutagenizing a DNA molecule at a target locus by prime editing, the method comprising: (a) contacting the DNA molecule at the target locus with a (i) fusion protein comprising a nucleic acid programmable DNA binding protein (napDNAbp) and an error-prone polymer (e.g., error-prone reverse transcriptase), and (ii) a guide RNA comprising an edit template comprising a desired nucleotide change; thereby polymerizing a single stranded DNA templated from the edit template; and incorporating the single stranded DNA into the DNA molecule at the target locus through a DNA repair and/or replication process.

Embodiment 2. The method of any prior embodiment, wherein the fusion protein comprises the amino acid sequence of PE1, PE2, or PE3.

Embodiment 3. The method of any prior embodiment, wherein the napDNAbp is a Cas9 nickase (nCas9).

Embodiment 4. The method of embodiment 1, wherein the napDNAbp comprises the amino acid sequence of SEQ ID NOs: 18-88, 126, 130, 137, 141, 147, 153, 157, 445, 460, 467, and 482-487.

Embodiment 5. The method of embodiment 1, wherein the guide RNA comprises SEQ ID NO: 222.

Embodiment 6. A method of installing an immunoepitope in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety;

thereby polymerizing a single strand DNA sequence encoding the immunoepitope;

thereby incorporating the single strand DNA sequence in place of a corresponding endogenous strand at the target nucleotide sequence through a DNA repair and/or replication process;

wherein the method produces a recombinant target nucleotide sequence that encodes a fusion protein comprising the protein of interest and the immunoepitope.

Embodiment 7. The method of embodiment 6, wherein the immunoepitope is selected from the group consisting of: tetanus toxoid (SEQ ID NO: 396); diphtheria toxin mutant CRM197 (SEQ ID NO: 630); mumps immunoepitope 1 (SEQ ID NO: 400); mumps immunoepitope 2 (SEQ ID NO: 402); mumps immunoeptitope 3 (SEQ ID NO: 404); rubella virus (SEQ ID NO: 406); hemagglutinin (SEQ ID NO: 408); neuraminidase (SEQ ID NO: 410); TAP1 (SEQ ID NO: 412); TAP2 (SEQ ID NO: 414); hemagglutinin epitopes toward class I HLA (SEQ ID NO: 416); neuraminidase epitopes toward class I HLA (SEQ ID NO: 418); hemagglutinin epitopes toward class II HLA (SEQ ID NO: 420); neuraminidase epitopes toward class II HLA (SEQ ID NO: 422); hemagglutinin epitope H5N1-bound class I and class II HLA (SEQ ID NO: 424); and neuraminidase epitope H5N1-bound class I and class II HLA (SEQ ID NO: 426).

Embodiment 8. The method of embodiment 6, wherein the fusion protein comprises the amino acid sequence of PE1, PE2, or PE3.

Embodiment 9. The method of embodiment 6, wherein the napDNAbp is a Cas9 nickase (nCas9).

Embodiment 10. The method of embodiment 6, wherein the napDNAbp comprises the amino acid sequence of SEQ ID NOs: 18-88, 126, 130, 137, 141, 147, 153, 157, 445, 460, 467, and 482-487.

Embodiment 11. The method of embodiment 6, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 12. A method of installing a small molecule dimerization domain in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase, and (ii) a PEgRNA comprising an edit template encoding the small molecule dimerization domain;

thereby polymerizing a single strand DNA sequence encoding the immunoepitope;

thereby incorporating the single strand DNA sequence in place of a corresponding endogenous strand at the target nucleotide sequence through a DNA repair and/or replication process;

wherein the method produces a modified target nucleotide sequence that encodes a fusion protein comprising the protein of interest and the small molecule dimerization domain.

Embodiment 13. The method of embodiment 12 further comprising conducting the method on a second protein of interest.

Embodiment 14. The method of embodiment 13, wherein the first protein of interest and the second protein of interest dimerize in the presence of a small molecule that binds to the dimerization domain on each of said proteins.

Embodiment 15. The method of embodiment 12, wherein the small molecule binding domain is FKBP12 of SEQ ID NO: 488.

Embodiment 16. The method of embodiment 12, wherein the small molecule binding domain is FKBP12-F36V of SEQ ID NO: 489.

Embodiment 17. The method of embodiment 12, wherein the small molecule binding domain is cyclophilin of SEQ ID NOs: 490 and 493-494.

Embodiment 18. The method of embodiment 12, wherein the small molecule is a dimer of a small molecule as described herein.

Embodiment 19. The method of embodiment 12, wherein the fusion protein comprises the amino acid sequence of PE1, PE2, or PE3.

Embodiment 20. The method of embodiment 12, wherein the napDNAbp is a Cas9 nickase (nCas9).

Embodiment 21. The method of embodiment 12, wherein the napDNAbp comprises the amino acid sequence of SEQ ID NOs: 18-88, 126, 130, 137, 141, 147, 153, 157, 445, 460, 467, and 482-487.

Embodiment 22. The method of embodiment 12, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 23. A method of installing a peptide tag or epitope onto a protein using prime editing, comprising: contacting a target nucleotide sequence encoding the protein with a prime editor construct configured to insert therein a second nucleotide sequence encoding the peptide tag to result in a recombinant nucleotide sequence, such that the peptide tag and the protein are expressed from the recombinant nucleotide sequence as a fusion protein.

Embodiment 24. The method of embodiment 23, wherein the peptide tag is used for purification and/or detection of the protein.

Embodiment 25. The method of embodiment 23, wherein the peptide tag is a poly-histidine (e.g., HHHHHH SEQ ID NOs: 252-262), FLAG (e.g., DYKDDDDK) (SEQ ID NO: 2), V5 (e.g., GKPIPNPLLGLDST) (SEQ ID NO: 3), GCN4, HA (e.g., YPYDVPDYA) (SEQ ID NO: 5), Myc (e.g. EQKLISEED) (SEQ ID NO: 6), or GST.

Embodiment 26. The method of embodiment 23, wherein the peptide tag has an amino acid sequence selected from the group consisting of SEQ ID NO: 1-6, 245-249, 252-262, 264-273, 275-276, 281, 278-288, and 622.

Embodiment 27. The method of embodiment 23, wherein the peptide tag is fused to the protein by a linker.

Embodiment 28. The method of embodiment 23, wherein the fusion protein has the following structure: [protein]-[peptide tag] or [peptide tag]-[protein], wherein "]-[" represents an optional linker.

Embodiment 29. The method of embodiment 23, wherein the linker has an amino acid sequence of SEQ ID NO: 127, 165-176, 446, 453, and 767-769.

Embodiment 30. The method of embodiment 23, wherein the prime editor construct comprises a PEgRNA comprising the nucleotide sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 31. The method of embodiment 23, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 32. The method of embodiment 23, wherein the PEgRNA comprises a spacer, a gRNA core, and an extension arm, wherein the spacer is complementary to the target nucleotide sequence and the extension arm comprises a reverse transcriptase template that encodes the peptide tag.

Embodiment 33. A method of installing or deleting a functional moiety in a protein of interest encoded by a target nucleotide sequence by prime editing, the method comprising: (a) contacting the target nucleotide sequence with a (i) prime editor comprising a nucleic acid programmable DNA binding protein (napDNAbp) and a polymerase and (ii) a PEgRNA comprising an edit template encoding the functional moiety or deletion of same; (b) polymerizing a single strand DNA sequence encoding the functional moiety or deletion of same; and (c) incorporating the single strand DNA sequence in place of a corresponding endogenous strand at the target nucleotide sequence through a DNA repair and/or replication process, wherein the method produces a recombinant target nucleotide sequence that encodes a modified protein comprising the protein of interest and the functional moiety or the removal of same, wherein the functional moiety alters a modification state or localization state of the protein.

Embodiment 34. The method of embodiment 33, wherein functional moiety alters the phosphorylation, ubiquitylation, glycosylation, lipidation, hydroxylation, methylation, acetylation, crotonylation, or SUMOylation state of the protein of interest.

Group F. PE Delivery Methods and Compositions

Embodiment 1. A polypeptide comprising an N-terminal half or a C-terminal half of a prime editor fusion protein.

Embodiment 2. The polypeptide of embodiment 1, wherein the prime editor fusion protein comprises a nucleic acid programmable DNA binding protein (napDNAbp) domain and a polymerase domain.

Embodiment 3. The polypeptide of embodiment 1, wherein the prime editor fusion protein is capable of carrying out prime editing in the presence of a prime editing guide RNA (PEgRNA).

Embodiment 4. The polypeptide of embodiment 2, wherein the napDNAbp is a Cas9 protein or variant thereof.

Embodiment 5. The polypeptide of embodiment 2, wherein the napDNAbp is a nuclease with nickase activity.

Embodiment 6. The polypeptide of embodiment 2, wherein the napDNAbp is a nuclease active Cas9, a nuclease inactive Cas9 (dCas9), or a Cas9 nickase (nCas9).

Embodiment 7. The polypeptide of embodiment 2, wherein the napDNAbp is selected from the group consisting of: Cas9, Cas12e, Cas12d, Cas12a, Cas12b1, Cas13a, Cas12c, and Argonaute and optionally has a nickase activity.

Embodiment 8. The polypeptide of embodiment 1, wherein the polypeptide is formed by splitting a prime editor fusion protein at a split site.

Embodiment 9. The polypeptide of embodiment 8, wherein the split site is a peptide bond in the napDNAbp domain.

Embodiment 10. The polypeptide of embodiment 8, wherein the split site is a peptide bond in the polymerase domain.

Embodiment 11. The polypeptide of embodiment 8, wherein the split site is a peptide bond in a linker between the napDNAbp domain and the polymerase domain.

Embodiment 12. The polypeptide of embodiment 9, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, 600-700, 700-800, 800-900, 900-1000, 1000-1100, 1100-1200, 1200-1300, or 1300-1368 of SEQ ID NO: 18 (canonical SpCas9), or between any two equivalent amino acid residues of an SpCas9 homolog or equivalent of SEQ ID NO: 18.

Embodiment 13. The polypeptide of embodiment 9, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, or 600-667 of SEQ ID NO: 89 (canonical reverse transcriptase, M-MLV RT), or between any two equivalent amino acid residues of a reverse transcriptase homolog or equivalent of SEQ ID NO: 89.

Embodiment 14. The polypeptide of embodiment 1, wherein the polypeptide is an N-terminal half of a prime editor fusion protein.

Embodiment 15. The polypeptide of embodiment 1, wherein the polypeptide is a C-terminal half of a prime editor fusion protein.

Embodiment 16. A nucleotide sequence encoding a polypeptide of any of embodiments 1-15 and optionally a PEgRNA.

Embodiment 17. A virus genome comprising a nucleotide sequence encoding a polypeptide of any of embodiments 1-15 and optionally a PEgRNA.

Embodiment 18. The virus genome of embodiment 17, wherein the nucleotide sequence further comprises a promoter sequence suitable for expressing the polypeptide of any of embodiments 1-15.

Embodiment 19. The virus genome of embodiment 17, wherein the nucleotide sequence further comprises a sequence encoding a PEgRNA.

Embodiment 20. A virus particle comprising a genome comprising a nucleotide sequence encoding a polypeptide of any of embodiments 1-15 and optionally a PEgRNA.

Embodiment 21. The virus particle of embodiment 20, wherein the virus particle is an adenovirus particle, an adeno-associated virus particle, or a lentivirus particle.

Embodiment 22. The virus particle of embodiment 20, wherein the polypeptide encoded by the genome is an N terminal half of a prime editor fusion protein.

Embodiment 23. The virus particle of embodiment 20, wherein the polypeptide encoded by the genome is a C terminal half of a prime editor fusion protein.

Embodiment 24. A pharmaceutical composition comprising a virus particle of any of embodiments 20-23 and a pharmaceutical excipient.

Embodiment 25. A pharmaceutical composition comprising a virus particle of embodiment 22 (encoding the N terminal half) and a pharmaceutical excipient.

Embodiment 26. A pharmaceutical composition comprising a virus particle of embodiment 23 (encoding the C terminal half) and a pharmaceutical excipient.

Embodiment 27. A ribonucleoprotein (RNP) complex comprising a nucleotide sequence encoding a polypeptide of any of embodiments 1-15 and optionally a PEgRNA.

Embodiment 28. The ribonucleoprotein (RNP) complex of embodiment 27, wherein the polypeptide encoded by the genome is an N-terminal half of a prime editor fusion protein.

Embodiment 29. The ribonucleoprotein (RNP) complex of embodiment 27, wherein the polypeptide encoded by the genome is a C-terminal half of a prime editor fusion protein.

Embodiment 30. A pharmaceutical composition comprising a ribonucleoprotein (RNP) complex of any of embodiments 27-29 and a pharmaceutical excipient.

Embodiment 31. A pharmaceutical composition comprising the ribonucleoprotein (RNP) complex of embodiment 28 (encoding the N-terminal half) and a pharmaceutical excipient.

Embodiment 32. A pharmaceutical composition comprising the ribonucleoprotein (RNP) complex of embodiment 29 (encoding the C-terminal half) and a pharmaceutical excipient.

Embodiment 33. A pharmaceutical composition comprising a first AAV particle and a second AAV particle, wherein the first AAV vector expresses an N-terminal half of a prime editor fusion protein and the second AAV vector expresses a C-terminal half of a prime editor fusion protein, wherein the N-terminal half and the C-terminal half are combined within the cell to reconstitute the prime editor.

Embodiment 34. The pharmaceutical composition of embodiment 33, wherein the first or second AAV particle also expresses a PEgRNA that targets the reconstituted prime editor to a target DNA site.

Embodiment 35. The pharmaceutical composition of embodiment 33, wherein the prime editor fusion protein comprises a nucleic acid programmable DNA binding protein (napDNAbp) domain and a polymerase domain.

Embodiment 36. The pharmaceutical composition of embodiment 33, wherein the prime editor fusion protein is capable of carrying out prime editing in the presence of a prime editing guide RNA (PEgRNA).

Embodiment 37. The pharmaceutical composition of embodiment 35, wherein the napDNAbp is a Cas9 protein or variant thereof.

Embodiment 38. The pharmaceutical composition of embodiment 35, wherein the napDNAbp is a nuclease with a nickase activity.

Embodiment 39. The pharmaceutical composition of embodiment 35, wherein the napDNAbp is a nuclease active Cas9, a nuclease inactive Cas9 (dCas9), or a Cas9 nickase (nCas9).

Embodiment 40. The pharmaceutical composition of embodiment 35, wherein the napDNAbp is selected from the group consisting of: Cas9, Cas12e, Cas12d, Cas12a, Cas12b1, Cas13a, Cas12c, and Argonaute and optionally has a nickase activity.

Embodiment 41. The pharmaceutical composition of embodiment 33, wherein N-terminal and C-terminal halves are formed by splitting the prime editor fusion protein at a split site.

Embodiment 42. The pharmaceutical composition of embodiment 41, wherein the split site is a peptide bond in a napDNAbp domain.

Embodiment 43. The pharmaceutical composition of embodiment 41, wherein the split site is a peptide bond in a polymerase domain.

Embodiment 44. The pharmaceutical composition of embodiment 41, wherein the split site is a peptide bond in a linker.

Embodiment 45. The pharmaceutical composition of embodiment 41, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, 600-700, 700-800, 800-900, 900-1000, 1000-1100, 1100-1200, 1200-1300, or 1300-1368 of SEQ ID NO: 18 (canonical SpCas9), or between any two equivalent amino acid residues of an SpCas9 homolog or equivalent of SEQ ID NO: 18.

Embodiment 46. The pharmaceutical composition of embodiment 41, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, or 600-667 of SEQ ID NO: 89 (canonical reverse transcriptase, M-MLV RT), or between any two equivalent amino acid residues of a reverse transcriptase homolog or equivalent of SEQ ID NO: 89.

Embodiment 47. The pharmaceutical composition of embodiment 33, wherein the N-terminal half of the prime editor fusion protein has an amino acid sequence encoding the N-terminal prime editor fusion proteins as described herein.

Embodiment 48. The pharmaceutical composition of embodiment 33, wherein the C-terminal half of the prime editor fusion protein has an amino acid sequence encoding the N-terminal prime editor fusion proteins as described herein.

Embodiment 49. A method of delivering a prime editor fusion protein to a cell comprising transfecting the cell with a first AAV particle and a second AAV particle, wherein the first AAV vector expresses an N-terminal half of a prime editor fusion protein and the second AAV vector expresses a C-terminal half of a prime editor fusion protein, wherein the N-terminal half and the C-terminal half are combined within the cell to reconstitute the prime editor fusion protein.

Embodiment 50. The method of embodiment 49, wherein the first or second AAV particle also expresses a PEgRNA that targets the reconstituted prime editor to a target DNA site.

Embodiment 51. The method of embodiment 49, wherein the prime editor fusion protein comprises a nucleic acid programmable DNA binding protein (napDNAbp) domain and a polymerase domain.

Embodiment 52. The method of embodiment 49, wherein the prime editor fusion protein is capable of carrying out prime editing in the presence of an prime editing guide RNA (PEgRNA).

Embodiment 53. The method of embodiment 51, wherein the napDNAbp is a Cas9 protein or variant thereof.

Embodiment 54. The method of embodiment 53, wherein the napDNAbp is a nuclease with nickase activity.

Embodiment 55. The method of embodiment 53, wherein the napDNAbp is a nuclease active Cas9, a nuclease inactive Cas9 (dCas9), or a Cas9 nickase (nCas9).

Embodiment 56. The method of embodiment 53, wherein the napDNAbp is selected from the group consisting of: Cas9, Cas12e, Cas12d, Cas12a, Cas12b1, Cas13a, Cas12c, and Argonaute and optionally has a nickase activity.

Embodiment 57. The method of embodiment 49, wherein N-terminal and C-terminal halves are formed by splitting the prime editor fusion protein at a split site.

Embodiment 58. The method of embodiment 57, wherein the split site is a peptide bond in a napDNAbp domain.

Embodiment 59. The method of embodiment 57, wherein the split site is a peptide bond in a polymerase domain.

Embodiment 60. The method of embodiment 57, wherein the split site is a peptide bond in a linker.

Embodiment 61. The method of embodiment 57, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, 600-700, 700-800, 800-900, 900-1000, 1000-1100, 1100-1200, 1200-1300, or 1300-1368 of SEQ ID NO: 18 (canonical SpCas9), or between any two equivalent amino acid residues of an SpCas9 homolog or equivalent of SEQ ID NO: 18.

Embodiment 62. The method of embodiment 57, wherein the split site is in the peptide bond between residues 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 16 and 17, 17 and 18, 18 and 19, 19 and 20, 20 and 21, 21 and 22, 22 and 23, 23 and 24, 24 and 25, 25 and 26, 26 and 27, 27 ad 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, or between any two residues between residues 50-100, 100-150, 150-200, 200-250, 250-300, 300-350, 350-400, 400-450, 450-500, 500-600, or 600-667 of SEQ ID NO: 89 (canonical reverse transcriptase, M-MLV RT), or between any two equivalent amino acid residues of a reverse transcriptase homolog or equivalent of SEQ ID NO: 89.

Embodiment 63. The method of embodiment 49, wherein the N-terminal half of the prime editor fusion protein has an amino acid sequence encoding the N-terminal prime editor fusion proteins as described herein.

Embodiment 64. The method of embodiment 49, wherein the C-terminal half of the prime editor fusion protein has an amino acid sequence encoding the C-terminal prime editor fusion proteins as described herein.

Embodiment 65. The method of embodiment 49, wherein the first AAV particle comprises a recombinant AAV genome comprising a nucleotide sequence which encodes the first prime editor component.

Embodiment 66. The method of embodiment 49, wherein the second AAV particle comprises a recombinant AAV genome comprising a nucleotide sequence which encodes the second prime editor component.

Embodiment 67. The method of embodiment 49, wherein the transfecting step is conducted in vivo.

Embodiment 68. The method of embodiment 49, wherein the transfecting step is conducted ex vivo.

Embodiment 69. The method of embodiment 50, wherein the target DNA site is a disease-associated gene.

Embodiment 70. The method of embodiment 69, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylkeotnuria; Severe Combined Immunodeficiency; Sickle Cell Disease; Smith-Lemli-Opitz Syndrome; a trinucleotide repeat disorder; a prion disease; and Tay-Sachs Disease.

Embodiment 71. The method of embodiment 69, wherein the disease-associated gene is associated with a polygenic disorder selected from the group consisting of: heart disease; high blood pressure; Alzheimer's disease; arthritis; diabetes; cancer; and obesity.

Embodiment 72. The method of embodiment 51, wherein the programmable DNA binding protein (napDNAbp) domain.

Embodiment 73. The method of embodiment 51, wherein the polymerase domain is a reverse transcriptase.

Embodiment 74. The method of embodiment 73, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 75. The method of embodiment 73, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 76. The method of embodiment 73, wherein the napDNAbp comprises an amino acid sequence of SEQ ID NO: 18.

Embodiment 77. The method of embodiment 73, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 78. The polypeptide of embodiment 8, wherein the split site is between 1023 and 1024 of SEQ ID NO: 18, or at a corresponding position in an amino acid sequence having at least 85%, at least 90%, at least 95%, at least 99%, or at least 99.5% sequence identity with SEQ ID NO: 18.

Group G. PE Methods for Modifying RNA Structure/Function

Embodiment 1. A method of installing a ribonucleotide motif or tag in an RNA of interest encoded by a target nucleotide sequence by prime editing, the method comprising: (a) contacting the target nucleotide sequence with a (i) prime editor comprising a nucleic acid programmable DNA binding protein (napDNAbp) and a polymerase, and (ii) a PEgRNA comprising an edit template encoding the ribonucleotide motif or tag; thereby polymerizing a single strand DNA sequence encoding the ribonucleotide motif or tag; and incorporating the single strand DNA sequence in place of a corresponding endogenous strand at the target nucleotide sequence through a DNA repair and/or replication process, wherein the method produces a target nucleotide sequence that encodes a modified RNA of interest comprising the ribonucleotide motif or tag.

Embodiment 2. The method of embodiment 1, wherein ribonucleotide motif or tag is a detection moiety.

Embodiment 3. The method of embodiment 1, wherein the ribonucleotide motif or tag affects the expression level of the RNA of interest.

Embodiment 4. The method of embodiment 1, wherein the ribonucleotide motif or tag affects the transport or subcellular location of the RNA of interest.

Embodiment 5. The method of embodiment 1, wherein the ribonucleotide motif or tag is selected from the group consisting of SV40 type 1, SV40 type 2, SV40 type 3, hGH, BGH, rbGlob, TK, MALAT1 ENE-mascRNA, KSHV PAN ENE, Smbox/U1 snRNA box, U1 snRNA 3' box, tRNA-lysine, broccoli aptamer, spinach aptamer, mango aptamer, HDV ribozyme, and m6A.

Embodiment 6. The method of embodiment 1, wherein the PEgRNA comprises SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777 (see Table).

Embodiment 7. The method of embodiment 1, wherein the fusion protein comprises the amino acid sequence of PE1, PE2, or PE3.

Embodiment 8. The method of embodiment 1, wherein the napDNAbp is a Cas9 nickase (nCas9).

Embodiment 9. The method of embodiment 1, wherein the napDNAbp comprises the amino acid sequence of SEQ ID NOs: 18-88, 126, 130, 137, 141, 147, 153, 157, 445, 460, 467, and 482-487.

Group H. PE Methods for Making Gene Libraries

Embodiment 1. A method of constructing a programmed mutant gene library by prime editing, the method comprising:
(a) contacting a library of target nucleotide sequences each comprising one or more target genetic loci with a (i) prime editor comprising a nucleic acid programmable DNA binding protein (napDNAbp) and a polymerase, and (ii) a PEgRNA comprising an edit template comprising a sequence having at least one genetic change relative to the one or more target genetic loci;
thereby polymerizing a single strand DNA sequence templated by the edit template; and
incorporating the single strand DNA sequence in place of the one or more target genetic loci through a DNA repair and/or replication process, thereby incorporating the at least one genetic change into the target genetic loci of the target nucleotide sequences of said library.

Embodiment 2. The method of embodiment 1, wherein the library is a plasmid library.

Embodiment 3. The method of embodiment 1, wherein the library is a phage library.

Embodiment 4. The method of embodiment 1, wherein the one or more target genetic loci comprise a region encoding a protein.

Embodiment 5. The method of embodiment 1, wherein the one or more target genetic loci comprise a region encoding a secondary structure motif of a protein.

Embodiment 6. The method of embodiment 5, wherein the secondary structure motif is an alpha helix.

Embodiment 7. The method of embodiment 5, wherein the secondary structure motif is a beta sheet.

Embodiment 8. The method of embodiment 1, wherein the napDNAbp is a Cas9 protein or variant thereof.

Embodiment 9. The method of embodiment 1, wherein the napDNAbp is a nuclease with a nickase activity.

Embodiment 10. The method of embodiment 1, wherein the napDNAbp is a nuclease active Cas9, a nuclease inactive Cas9 (dCas9), or a Cas9 nickase (nCas9).

Embodiment 11. The method of embodiment 1, wherein the napDNAbp comprises an amino acid sequence of SEQ ID NO: 18.

Embodiment 12. The method of embodiment 1, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 13. The method of embodiment 1, wherein the polymerase domain is a reverse transcriptase.

Embodiment 14. The method of embodiment 13, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 15. The method of embodiment 14, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 16. The method of embodiment 1, wherein the at least one genetic change in the edit template is an insertion.

Embodiment 17. The method of embodiment 1, wherein the at least one genetic change in the edit template is a deletion.

Embodiment 18. The method of embodiment 1, wherein the at least one genetic change in the edit template is substitution.

Embodiment 19. The method of embodiment 1, wherein the at least one genetic change is an insertion of one or more codons.

Embodiment 20. The method of embodiment 1, wherein the at least one genetic change is a deletion of one or more codons.

Embodiment 21. The method of embodiment 1, wherein the at least one genetic change is the insertion of a stop codon.

Embodiment 22. The method of embodiment 1, wherein the at least one genetic change is the conversion of a non-stop codon to a stop codon.

Embodiment 23. The method of embodiment 1, wherein the method is conduct simultaneously at least 2, or 3, or 4, or 5, or 6, or 7, or 8, or 9, or 10, or between 10-100, or between 100-200, or between 200-300, or between 300-400, or between 400-500 target genetic loci in each of the target nucleotide sequences of the library.

Embodiment 24. The method of embodiment 1, wherein the method is conducted during PACE or PANCE evolution, and wherein each instance of incorporating the at least one genetic change into the target genetic loci of the target nucleotide sequences of said library also installs a new target sequence.

Group I. PE Methods for Off-Target Detection

Embodiment 1. A method of evaluating off-target editing by a prime editor, the method comprising:
(a) contacting a target nucleotide sequence having an edit site with a (i) prime editor fusion protein comprising a nucleic acid programmable DNA binding protein (napDNAbp) and a polymerase and (ii) a PEgRNA comprising a DNA synthesis template that encodes a detectable sequence;
wherein the PEgRNA complexes with the fusion protein and guides said fusion protein to the edit site and, if present, to one or more off-target sites;
and wherein the prime editor fusion protein installs the detectable sequence at the edit site, and, if present, at the one or more off-target sites;
(b) determining the nucleotide sequence of the edit site and the one or more off-target sites.

Embodiment 2. The method of embodiment 1, wherein the target nucleotide sequence is a genome.

Embodiment 3. The method of embodiment 1, wherein the step of contacting is in vitro.

Embodiment 4. The method of embodiment 1, wherein the step of contacting is in vivo.

Embodiment 5. The method of embodiment 1, wherein the edit site is a mutation in a disease-associated gene.

Embodiment 6. The method of embodiment 5, wherein the mutation is a single base substitution, insertion, deletion, or inversion.

Embodiment 7. The method of embodiment 1, wherein the disease-associated gene is associated with a monogentic disorder selected from the group consisting of: Adenosine Deaminase (ADA) Deficiency; Alpha-1 Antitrypsin Deficiency; Cystic Fibrosis; Duchenne Muscular Dystrophy; Galactosemia; Hemochromatosis; Huntington's Disease; Maple Syrup Urine Disease; Marfan Syndrome; Neurofibromatosis Type 1; Pachyonychia Congenita; Phenylketonuria; Severe Combined Immunodeficiency; Sickle Cell Disease; Smith-Lemli-Opitz Syndrome; and Tay-Sachs Disease.

Embodiment 8. The method of embodiment 1, wherein the disease-associated gene is associated with a polygenic disorder selected from the group consisting of: heart disease; high blood pressure; Alzheimer's disease; arthritis; diabetes; cancer; and obesity.

Embodiment 9. The method of embodiment 1, wherein the fusion protein has an amino acid sequence of SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777, or an amino acid sequence having at least 80%, 85%, 90%, 95%, 98%, or 99% sequence identity with SEQ ID NOs: 101-104, 181-183, 223-244, 277, 325-334, 336, 338, 340, 342, 344, 346, 348, 350, 352, 354, 356, 358, 360, 362, 364, 366, 368, 499-505, 735-761, 776-777.

Embodiment 10. The method of embodiment 1, wherein the napDNAbp is Cas9, Cas12e, Cas12d, Cas12a, Cas12b1, Cas13a, Cas12c, or Argonaute, or a variant of Cas9, Cas12e, Cas12d, Cas12a, Cas12b1, Cas13a, Cas12c, or Argonaute.

Embodiment 11. The method of embodiment 1, wherein the napDNAbp is a Cas9 or variant thereof.

Embodiment 12. The method of embodiment 1, wherein the napDNAbp is a nuclease active Cas9, a nuclease inactive Cas9 (dCas9), or a Cas9 nickase (nCas9).

Embodiment 13. The method of embodiment 1, wherein the napDNAbp is Cas9 nickase (nCas9).

Embodiment 14. The method of embodiment 1, wherein the napDNAbp comprises the amino acid sequence of SEQ ID NO: 18, or an amino acid sequence having at least 80%, 85%, 90%, 95%, 98%, or 99% sequence identity with SEQ ID NO: 18.

Embodiment 15. The method of embodiment 1, wherein the napDNAbp is SpCas9 wild type or a variant thereof of any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 16. The method of embodiment 1, wherein the napDNAbp is an SpCas9 ortholog.

Embodiment 17. The method of embodiment 1, wherein the napDNAbp is any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 18. The method of embodiment 1, wherein the napDNAbp comprises an amino acid sequence having at least 80%, 85%, 90%, 95%, 98%, or 99% sequence identity with the amino acid sequence of any one of SEQ ID NOs: 18-88, 126, 130, 137, 141, 147, 153, 157, 445, 460, 467, and 482-487.

Embodiment 19. The method of embodiment 1, wherein the polymerase comprises an RNA-dependent DNA polymerase activity.

Embodiment 20. The method of embodiment 1, wherein the polymerase is a reverse transcriptase.

Embodiment 21. The method of embodiment 1, wherein the reverse transcriptase is a naturally occuring wild type reverse transcriptase having an amino acid sequence of any one of SEQ ID NOs: 89 or an amino acid sequence having at least 80%, 85%, 90%, 95%, 98%, or 99% sequence identity with any of SEQ ID NOs: 89.

Embodiment 22. The method of embodiment 1, wherein the reverse transcriptase is a variant reverse transcriptase having an amino acid sequence of any one of SEQ ID NOs: 89-100, 105-122, 128-129, 132, 139, 143, 149, 154, 159, 235, 454, 471, 516, 662, 700, 701-716, 739-741, and 766 or an amino acid sequence having at least 80%, 85%, 90%, 95%, 98%, or 99% sequence identity with any of SEQ ID NOs: 89-100, 105-122, 128-129, 132, 139, 143, 149, 154, 159, 235, 454, 471, 516, 662, 700, 701-716, 739-741, and 766.

Embodiment 23. The method of embodiment 1, wherein the reverse transcriptase comprises any one of the amino acid sequences of SEQ ID NOs: 89-100, 105-122, 128-129, 132, 139, 143, 149, 154, 159, 235, 454, 471, 516, 662, 700, 701-716, 739-741, and 766.

Embodiment 24. The method of embodiment 1, wherein the reverse transcriptase comprises an amino acid sequence having at least 80%, 85%, 90%, 95%, 98%, or 99% sequence identity with the amino acid sequence of any one of SEQ ID NOs: 89-100, 105-122, 128-129, 132, 139, 143, 149, 154, 159, 235, 454, 471, 516, 662, 700, 701-716, 739-741, and 766.

Embodiment 25. The method of embodiment 1, wherein the detectable sequence is an insertion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 26. The method of embodiment 1, wherein the detectable sequence is a deletion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 27. The method of embodiment 1, wherein the detectable sequence is a nucleobase substitution.

Embodiment 28. The method of embodiment 1, wherein the detectable sequence is a transition mutation.

Embodiment 29. The method of embodiment 1, wherein the detectable sequence is a transversion mutation.

Embodiment 30. The method of embodiment 1, wherein the detectable sequence is a single nucleotide substitution selected from the group consisting of: (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, and (12) an A to C substitution.

Embodiment 31. The method of embodiment 1, wherein the detectable sequence is a single nucleotide substitution that converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 32. The method of embodiment 1, wherein the detectable sequence is a barcode sequence.

Embodiment 33. The method of embodiment 1, wherein step (d) of determining the nucleotide sequence at the on-target and off-target sites comprises (i) fragmenting the target nucleotide sequence to form fragments, (ii) attaching adapter sequences to the ends of the fragments, (iii) PCR amplifying an amplicon using a pair of primers wherein one primer anneals to an adapter sequence attached at one end of the fragments, and another primer that anneals to an adapter sequence inserted by prime editing located within the fragment, and (iv) sequencing the amplicon to determine the location of the edit.

Group J. PE Methods for Cell Data Recording

Embodiment 1. A method of recording a cellular event by prime editing, the method comprising: (A) introducing into a cell one or more constructs encoding (i) a prime editor fusion protein comprising an napDNAbp and an RNA-dependent DNA polymerase and (ii) a PEgRNA, wherein the expression of the fusion protein and/or the PEgRNA is induced by the occurrence of a cellular event, and wherein upon expression of the fusion protein and/or the PEgRNA results in prime editing of a target edit site in the genome of the cell to introduce a detectable sequence, and (B) identifying the detectable sequence, thereby identifying the occurrence of the cellular event.

Embodiment 2. The method of embodiment 1, wherein the prime editing of step (A) simultaneously introduces a new target edit site such that the recording of the cellular event may occur iteratively.

Embodiment 3. The method of embodiment 1, wherein the PEgRNA comprises an edit template that encodes the detectable sequence.

Embodiment 4. The method of embodiment 3, wherein the edit template further encodes a new target edit site.

Embodiment 5. The method of embodiment 1, wherein the detectable sequence is an insertion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 6. The method of embodiment 1, wherein the detectable sequence is a deletion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 7. The method of embodiment 1, wherein the detectable sequence is a nucleobase substitution.

Embodiment 8. The method of embodiment 1, wherein the detectable sequence is a transition mutation.

Embodiment 9. The method of embodiment 1, wherein the detectable sequence is a transversion mutation.

Embodiment 10. The method of embodiment 1, wherein the detectable sequence is a single nucleotide substitution of wherein the single nucleotide substitution is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

Embodiment 11. The method of embodiment 1, wherein the detectable sequence is a single nucleotide substitution that converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 12. The method of embodiment 1, wherein the detectable sequence is a barcode sequence.

Embodiment 13. The method of embodiment 1, wherein the detectable sequence increases in length over time as a result of iterative insertion of the detectable sequence for each occurrence of the cellular event.

Embodiment 14. The method of embodiment 1, wherein the detecting step comprises sequencing the edited target site, or an amplicon of the edited target site.

Embodiment 15. The method of embodiment 1, wherein the napDNAbp is Cas9, Cas12e, Cas12d, Cas12a, Cas12b1, Cas13a, Cas12c, or Argonaute, or a variant of Cas9, Cas12e, Cas12d, Cas12a, Cas12b1, Cas13a, Cas12c, or Argonaute.

Embodiment 16. The method of embodiment 1, wherein the napDNAbp is a Cas9 or variant thereof.

Embodiment 17. The method of embodiment 1, wherein the napDNAbp is a nuclease active Cas9, a nuclease inactive Cas9 (dCas9), or a Cas9 nickase (nCas9).

Embodiment 18. The method of embodiment 1, wherein the napDNAbp is Cas9 nickase (nCas9).

Embodiment 19. The method of embodiment 1, wherein the napDNAbp comprises the amino acid sequence of SEQ ID NO: 18, or an amino acid sequence having at least 80%, 85%, 90%, 95%, 98%, or 99% sequence identity with SEQ ID NO: 18.

Embodiment 20. The method of embodiment 1, wherein the napDNAbp is SpCas9 wild type or a variant thereof of any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 21. The method of embodiment 1, wherein the napDNAbp is an SpCas9 ortholog.

Embodiment 22. The method of embodiment 1, wherein the napDNAbp is any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 23. The method of embodiment 1, wherein the RNA-dependent DNA polymerase is a reverse transcriptase.

Embodiment 24. The method of embodiment 23, wherein the reverse transcriptase is a naturally occuring wild type reverse transcriptase having an amino acid sequence of any one of SEQ ID NOs: 89 or an amino acid sequence having at least 80%, 85%, 90%, 95%, 98%, or 99% sequence identity with any of SEQ ID NOs: 89.

Embodiment 25. The method of embodiment 23, wherein the reverse transcriptase is a variant reverse transcriptase having an amino acid sequence of any one of SEQ ID NOs: 89-100, 105-122, 128-129, 132, 139, 143, 149, 154, 159, 235, 454, 471, 516, 662, 700, 701-716, 739-741, and 766 or an amino acid sequence having at least 80%, 85%, 90%, 95%, 98%, or 99% sequence identity with any of SEQ ID NOs: 89-100, 105-122, 128-129, 132, 139, 143, 149, 154, 159, 235, 454, 471, 516, 662, 700, 701-716, 739-741, and 766.

Embodiment 26. The method of embodiment 1, wherein the fusion protein comprises an amino acid sequence of any one of SEQ ID NOs: 123 and 134 (PE1, PE2), or an amino acid sequence having at least 80%, 85%, 90%, 95%, 98%, or 99% sequence identity with any of SEQ ID NOs:123 and 134 (PE1, PE2).

Embodiment 27. The method of embodiment 1, wherein the one or more constructs that encode the prime editor fusion protein and/or the PEgRNA further comprises one or more promoters which are inducible when cellular event occurs.

Embodiment 28. The method of embodiment 1, wherein the cellular event is marked by a stimulus received by the cell.

Embodiment 29. The method of embodiment 28, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 30. A cell data recording plasmid for recording a cellular event using prime editing, comprising:
  i. a fusion protein comprising (a) a nucleic acid sequence encoding a nucleic acid programmable DNA binding protein (napDNAbp) and a (b) RNA-dependent DNA polymerase, said fusion protein being operably linked to a first promoter;
  ii. a nucleic acid sequence encoding a prime editor guide RNA (PEgRNA) operably linked to a second promoter, wherein the PEgRNA is complementary to a target sequence; and
  iii. an origin of replication;
  wherein at least one of the promoters is an inducible promoter, and wherein the PEgRNA associates with the napDNAbp under conditions that induce expression of the PEgRNA and expression of the napDNAbp sufficiently to install a detectable sequence at a target edit site.

Embodiment 31. The cell data recording plasmid of embodiment 30, wherein the inducible promoter is induced by the cellular event.

Embodiment 32. The cell data recording plasmid of embodiment 30, wherein the cellular event is marked by a stimulus received by the cell.

Embodiment 33. The cell data recording plasmid of embodiment 32, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 34. The cell data recording plasmid of embodiment 30, wherein the first and second promoter are the same.

Embodiment 35. The cell data recording plasmid of embodiment 30, wherein the first and second promoter are different.

Embodiment 36. The cell data recording plasmid of embodiment 30, wherein the at least one inducible promoter is an anhydrotetracycline-inducible promoter, IPTG-inducible promoter, rhamnose-inducible promoter, or arabinose-inducible promoter.

Embodiment 37. The cell data recording plasmid of embodiment 30, wherein the first or second promoter is a constitutive promoter.

Embodiment 38. The cell data recording plasmid of embodiment 37, wherein the constitutive promoter is a Lac promoter, cytomegalovirus (CMV) promoter, a constitutive RNA polymerase III promoter, or a UBC promoter.

Embodiment 39. The cell data recording plasmid of embodiment 30, wherein the origin of replication comprises a pSC101, pMB1, pBR322, ColE1, or p15A origin of replication sequence.

Embodiment 40. The cell data recording plasmid of embodiment 30, wherein the PEgRNA comprises an edit template that encodes the detectable sequence.

Embodiment 41. The cell data recording plasmid of embodiment 40, wherein the edit template further encodes a new target edit site.

Embodiment 42. The cell data recording plasmid of embodiment 30, wherein the detectable sequence is an insertion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 43. The cell data recording plasmid of embodiment 30, wherein the detectable sequence is a deletion of at least 1, or at least 2, or at least 3, or at least 4, or at least 5, or at least 6, or at least 7, or at least 8, or at least 9, or at least 10, or at least 11, or at least 12, or at least 13, or at least 14, or at least 15, or at least 16, or at least 17, or at least 18, or at least 19, or at least 20, or at least 21, or at least 22, or at least 23, or at least 24, or at least 25, or at least 26, or at least 27, or at least 28, or at least 29, or at least 30, or at least 31, or at least 32, or at least 33, or at least 34, or at least 35, or at least 40, or at least 50, or at least 60, or at least 70, or at least 80, or at least 90, or at least 100 nucleobases.

Embodiment 44. The cell data recording plasmid of embodiment 30, wherein the detectable sequence is a nucleobase substitution.

Embodiment 45. The cell data recording plasmid of embodiment 30, wherein the detectable sequence is a transition mutation.

Embodiment 46. The cell data recording plasmid of embodiment 30, wherein the detectable sequence is a transversion mutation.

Embodiment 47. The cell data recording plasmid of embodiment 30, wherein the detectable sequence is a single nucleotide substitution of wherein the single nucleotide substitution is (1) a G to T substitution, (2) a G to A substitution, (3) a G to C substitution, (4) a T to G substitution, (5) a T to A substitution, (6) a T to C substitution, (7) a C to G substitution, (8) a C to T substitution, (9) a C to A substitution, (10) an A to T substitution, (11) an A to G substitution, or (12) an A to C substitution.

Embodiment 48. The cell data recording plasmid of embodiment 30, wherein the detectable sequence is a single nucleotide substitution that converts (1) a G:C basepair to a T:A basepair, (2) a G:C basepair to an A:T basepair, (3) a G:C basepair to C:G basepair, (4) a T:A basepair to a G:C basepair, (5) a T:A basepair to an A:T basepair, (6) a T:A basepair to a C:G basepair, (7) a C:G basepair to a G:C basepair, (8) a C:G basepair to a T:A basepair, (9) a C:G basepair to an A:T basepair, (10) an A:T basepair to a T:A basepair, (11) an A:T basepair to a G:C basepair, or (12) an A:T basepair to a C:G basepair.

Embodiment 49. The cell data recording plasmid of embodiment 30, wherein the detectable sequence is a barcode sequence.

Embodiment 50. The cell data recording plasmid of embodiment 30, wherein the detectable sequence increases in length over time as a result of iterative insertion of the detectable sequence for each occurrence of the cellular event.

Embodiment 51. The cell data recording plasmid of embodiment 30, wherein the detecting step comprises sequencing the edited target site, or an amplicon of the edited target site.

Embodiment 52. The cell data recording plasmid of embodiment 30, wherein the napDNAbp is Cas9, Cas12e, Cas12d, Cas12a, Cas12b1, Cas13a, Cas12c, or Argonaute, or a variant of Cas9, Cas12e, Cas12d, Cas12a, Cas12b1, Cas13a, Cas12c, or Argonaute.

Embodiment 53. The cell data recording plasmid of embodiment 30, wherein the napDNAbp is a Cas9 or variant thereof.

Embodiment 54. The cell data recording plasmid of embodiment 30, wherein the napDNAbp is a nuclease active Cas9, a nuclease inactive Cas9 (dCas9), or a Cas9 nickase (nCas9).

Embodiment 55. The cell data recording plasmid of embodiment 30, wherein the napDNAbp is Cas9 nickase (nCas9).

Embodiment 56. The cell data recording plasmid of embodiment 30, wherein the napDNAbp comprises the amino acid sequence of SEQ ID NO: 18, or an amino acid sequence having at least 80%, 85%, 90%, 95%, 98%, or 99% sequence identity with SEQ ID NO: 18.

Embodiment 57. The cell data recording plasmid of embodiment 30, wherein the napDNAbp is SpCas9 wild type or a variant thereof of any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 58. The cell data recording plasmid of embodiment 30, wherein the napDNAbp is an SpCas9 ortholog.

Embodiment 59. The cell data recording plasmid of embodiment 30, wherein the napDNAbp is any one of amino acid sequences SEQ ID NOs: 18-88, 126, 130, 137, 141, 147, 153, 157, 445, 460, 467, and 482-487, or an amino acid sequence having at least 80%, 85%, 90%, 95%, 98%, or 99% sequence identity with any of SEQ ID NOs: 18-88, 126, 130, 137, 141, 147, 153, 157, 445, 460, 467, and 482-487.

Embodiment 60. The cell data recording plasmid of embodiment 30, wherein the RNA-dependent DNA polymerase is a reverse transcriptase.

Embodiment 61. The cell data recording plasmid of embodiment 30, wherein the reverse transcriptase is a naturally occuring wild type reverse transcriptase having an amino acid sequence of any one of SEQ ID NOs: 89 or an amino acid sequence having at least 80%, 85%, 90%, 95%, 98%, or 99% sequence identity with any of SEQ ID NOs: 89.

Embodiment 62. The cell data recording plasmid of embodiment 30, wherein the reverse transcriptase is a variant reverse transcriptase having an amino acid sequence of any one of SEQ ID NOs: 89-100, 105-122, 128-129, 132, 139, 143, 149, 154, 159, 235, 454, 471, 516, 662, 700, 701-716, 739-741, and 766 or an amino acid sequence having at least 80%, 85%, 90%, 95%, 98%, or 99% sequence identity with any of SEQ ID NOs: 89-100, 105-122, 128-129, 132, 139, 143, 149, 154, 159, 235, 454, 471, 516, 662, 700, 701-716, 739-741, and 766.

Embodiment 63. The cell data recording plasmid of embodiment 30, wherein the fusion protein comprises an amino acid sequence of any one of SEQ ID NOs: 123 and 134 (PE1, PE2), or an amino acid sequence having at least 80%, 85%, 90%, 95%, 98%, or 99% sequence identity with any of SEQ ID NOs: 123 and 134 (PE1, PE2).

Embodiment 64. A kit for use in a cell comprising the cell data recorder plasmid of any one of embodiments 30 63.

Embodiment 65. The kit of embodiment 64, wherein the cell is a prokaryotic cell.

Embodiment 66. The kit of embodiment 64, wherein the cell is a eukaryotic cell.

Embodiment 67. A cell comprising the cell data recording plasmid of any one of embodiments 30-63.

Embodiment 68. The cell of embodiment 67, wherein the cell is a prokaryotic cell.

Embodiment 69. The cell of embodiment 67, wherein the cell is a eukaryotic cell.

Embodiment 70. The cell of embodiment 69, wherein the eukaryotic cell is a mammalian cell.

Embodiment 71. The cell of embodiment 70, wherein the mammalian cell is a human cell.

Embodiment 72. A method of recording a cellular event by prime editing, the method comprising: (A) introducing into a cell a cell data recording plasmid of any of embodiments 30-63, wherein the fusion protein and/or the PEgRNA are induced by the occurrence of a cellular event, and wherein expression of the fusion protein and/or the PEgRNA results in prime editing of a target edit site in the genome of the cell to introduce a detectable sequence, and (B) identifying the detectable sequence, thereby identifying the occurrence of the cellular event.

Embodiment 73. The method of embodiment 72, wherein the step of (A) introducing is by transfection or electroporation.

EQUIVALENTS AND SCOPE

In the articles such as "a," "an," and "the" may mean one or more than one unless indicated to the contrary or otherwise evident from the context. Embodiments or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the disclosure encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claims that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the disclosure or aspects of the disclosure consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the embodiments. Because such embodiments are deemed to be known to one of ordinary skill in the art, they may be excluded even if the exclusion is not set forth explicitly herein. Any particular embodiment of the invention can be excluded from any embodiment, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended embodiments. Those of ordinary skill in the art will appreciate that various changes and modifications to this description may be made without departing from the spirit or scope of the present invention, as defined in the following embodiments.

SEQUENCE LISTING (4081 sequences)

SEQ ID NO: 1 - protein, 12 aa, Artificial Sequence
  Synthetic
FLNCCPGCCMEP

SEQ ID NO: 2 - protein, 8 aa, Artificial Sequence
  Synthetic
DYKDDDDK

SEQ ID NO: 3 - protein, 14 aa, Artificial Sequence
  Synthetic
GKPIPNPLLGLDST

SEQ ID NO: 4 - protein, 19 aa, Artificial Sequence
  Synthetic
EELLSKNYHLENEVARLKK

SEQ ID NO: 5 - protein, 9 aa, Artificial Sequence
  Synthetic
YPYDVPDYA

SEQ ID NO: 6 - protein, 10 aa, Artificial Sequence
  Synthetic
EQKLISEEDL

SEQ ID NO: 7 - protein, 380 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 8 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 9 - protein, 413 aa, Artificial Sequence
  Synthetic
CLAEGTRIFDPVTGTTHRIEDVVDGRKPIHVVAVAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYTNVVPLYDLLLEMLDAHRLHAGGSGASRVQAFADALDDKFLHDMLAEELRYSVIREVLPTRRARTFDLEVEELHTLVAEGVVVHNC

SEQ ID NO: 10 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 11 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 12 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPIPYSEYDPTSPFSEASMMGLLTNLADRELVHMINWAKRVPGFVDLTLHDQAHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 13 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGATVWATPDHKVLTEYGWRAAGELRKGDRVAGPGGSGNSLALSLTADQMVSALLDAEPPILYSEYNPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 14 - protein, 413 aa, Artificial Sequence
  Synthetic
CLAEGTRIFDPVTGTTHRIEDVVDGRKPIHVVAAAKDGTLLARPVVSWFDQGTRDVIGLRIAGGAIVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEGLRYSVIREVLPTRRARTFDLEVEELHTLVAEGVVVHNC

SEQ ID NO: 15 - protein, 413 aa, Artificial Sequence
  Synthetic
CLAEGTRIFDPVTGTTHRIEDVVDGRKPIHVVAVAKDGTLLARPVVSWFDQGTRDVIGLRIAGGATVWATPDHKVLTEYGWRAAGELRKGDRVAGPGGSGNSLALSLTADQMVSALLDAEPPILYSEYDPTSPFSEASMMGLLTNLADRELVHMINWAKRVPGFVDLTLHDQAHLLERAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRALDKITDTLIHLMAKAGLTLQQQHQRLAQLLLILSHIRHMSNKGMEHLYSMKYKNVVPLYDLLLEMLDAHRLHAGGSGASRVQAFADALDDKFLHDMLAEELRYSVIREVLPTRRARTFDLEVEELHTLVAEGVVVHNC

SEQ ID NO: 16 - protein, 7 aa, Artificial Sequence
  Synthetic
PKKKRKV

SEQ ID NO: 17 - protein, 30 aa, Artificial Sequence
  Synthetic
MDSLLMNRRKFLYQFKNVRWAKGRRETYLC

SEQ ID NO: 18 - protein, 1368 aa, Streptococcus pyogenes [sequence omitted]

SEQ ID NO: 19 - DNA, 4104 bp, Streptococcus pyogenes
atggataaaaaatatagcattggcctggatattggcaccaacagcgtgggctgggcggtgattaccgatgaatataaagtgccgagcaaaaaatttaaagtgctgggcaacaccgatcgccatagcattaaaaaaaacctgattggcgcgctgctgtttgatagcggcgaaaccgcggaagcgacccgcctgaaacgcaccgcgcgccgccgctatacccgccgcaaaaaccgcatttgctatctgcaggaaatttttagcaacgaaatggcgaaagtggatgatagcttttttcatcgcctggaagaaagctttctggtggaagaagataaaaaacatgaacgccatccgatttttggcaacattgtggatgaagtggcgtatcatgaaaaatatccgaccatttatcatctgcgcaaaaaactggtggatagcaccgataaagcggatctgcgcctgatttatctggcgctggcgcatatgattaaatttcgcggccattttctgattgaaggcgatctgaacccggataacagcgatgtggataaactgtttattcagctggtgcagacctataaccagctgtttgaagaaaacccgattaacgcgagcggcgtggatgcgaaagcgattctgagcgcgcgcctgagcaaaagccgccgcctggaaaacctgattgcgcagctgccgggcgaaaaaaaaaacggcctgtttggcaacctgattgcgctgagcctgggcctgaccccgaactttaaaagcaactttgatctggcggaagatgcgaaactgcagctgagcaaagatacctatgatgatgatctggataacctgctggcgcagattggcgatcagtatgcggatctgtttctggcggcgaaaaacctgagcgatgcgattctgctgagcgatattctgcgcgtgaacaccgaaattaccaaagcgccgctgagcgcgagcatgattaaacgctatgatgaacatcatcaggatctgaccctgctgaaagcgctggtgcgccagcagctgccggaaaaatataaagaaattttttttgatcagagcaaaaacggctatgcgggctatattgatggcggcgcgagccaggaagaattttataaatttattaaaccgattctggaaaaaatggatggcaccgaagaactgctggtgaaactgaaccgcgaagatctgctgcgcaaacagcgcacctttgataacggcagcattccgcatcagattcatctgggcgaactgcatgcgattctgcgccgccaggaagatttttatccgtttctgaaagataaccgcgaaaaaattgaaaaaattctgacctttcgcattccgtattatgtgggcccgctggcgcgcggcaacagccgctttgcgtggatgacccgcaaaagcgaagaaaccattaccccgtggaactttgaagaagtggtggataaaggcgcgagcgcgcagagctttattgaacgcatgaccaactttgataaaaacctgccgaacgaaaaagtgctgccgaaacatagcctgctgtatgaatattttaccgtgtataacgaactgaccaaagtgaaatatgtgaccgaaggcatgcgcaaaccggcgtttctgagcggcgaacagaaaaaagcgattgtggatctgctgtttaaaaccaaccgcaaagtgaccgtgaaacagctgaaagaagattattttaaaaaaattgaatgctttgatagcgtggaaattagcggcgtggaagatcgctttaacgcgagcctgggcacctatcatgatctgctgaaaattattaaagataaagattttctggataacgaagaaaacgaagatattctggaagatattgtgctgaccctgaccctgtttgaagatcgcgaaatgattgaagaacgcctgaaaacctatgcgcatctgtttgatgataaagtgatgaaacagctgaaacgccgccgctataccggctggggccgcctgagccgcaaactgattaacggcattcgcgataaacagagcggcaaaaccattctggattttctgaaaagcgatggctttgcgaaccgcaactttatgcagctgattcatgatgatagcctgacctttaaagaagatattcagaaagcgcaggtgagcggccagggcgatagcctgcatgaacatattgcgaacctggcgggcagcccggcgattaaaaaaggcattctgcagaccgtgaaagtggtggatgaactggtgaaagtgatgggccgccataaaccggaaaacattgtgattgaaatggcgcgcgaaaaccagaccacccagaaaggccagaaaaacagccgcgaacgcatgaaacgcattgaagaaggcattaaagaactgggcagccagattctgaaagaacatccggtggaaaacacccagctgcagaacgaaaaactgtatctgtattatctgcagaacggccgcgatatgtatgtggatcaggaactggatattaaccgcctgagcgattatgatgtggatcatattgtgccgcagagctttctgaaagatgatagcattgataacaaagtgctgacccgcagcgataaaaaccgcggcaaaagcgataacgtgccgagcgaagaagtggtgaaaaaaatgaaaaactattggcgccagctgctgaacgcgaaactgattacccagcgcaaatttgataacctgaccaaagcggaacgcggcggcctgagcgaactggataaagcgggctttattaaacgccagctggtggaaacccgccagattaccaaacatgtggcgcagattctggatagccgcatgaacaccaaatatgatgaaaacgataaactgattcgcgaagtgaaagtgattaccctgaaaagcaaactggtgagcgattttcgcaaagattttcagttttataaagtgcgcgaaattaacaactatcatcatgcgcatgatgcgtatctgaacgcggtggtgggcaccgcgctgattaaaaaatatccgaaactggaaagcgaatttgtgtatggcgattataaagtgtatgatgtgcgcaaaatgattgcgaaaagcgaacaggaaattggcaaagcgaccgcgaaatattttttttatagcaacattatgaacttttttaaaaccgaaattaccctggcgaacggcgaaattcgcaaacgcccgctgattgaaaccaacggcgaaaccggcgaaattgtgtgggataaaggccgcgattttgcgaccgtgcgcaaagtgctgagcatgccgcaggtgaacattgtgaaaaaaaccgaagtgcagaccggcggctttagcaaagaaagcattctgccgaaacgcaacagcgataaactgattgcgcgcaaaaaagattgggatccgaaaaaatatggcggctttgatagcccgaccgtggcgtatagcgtgctggtggtggcgaaagtggaaaaaggcaaaagcaaaaaactgaaaagcgtgaaagaactgctgggcattaccattatggaacgcagcagctttgaaaaaaacccgattgattttctggaagcgaaaggctataaagaagtgaaaaaagatctgattattaaactgccgaaatatagcctgtttgaactggaaaacggccgcaaacgcatgctggcgagcgcgggcgaactgcagaaaggcaacgaactggcgctgccgagcaaatatgtgaactttctgtatctggcgagccattatgaaaaactgaaaggcagcccggaagataacgaacagaaacagctgtttgtggaacagcataaacattatctggatgaaattattgaacagattagcgaatttagcaaacgcgtgattctggcggatgcgaacctggataaagtgctgagcgcgtataacaaacatcgcgataaaccgattcgcgaacaggcggaaaacattattcatctgtttaccctgaccaacctgggcgcgccggcggcgtttaaatattttgataccaccattgatcgcaaacgctataccagcaccaaagaagtgctggatgcgaccctgattcatcagagcattaccggcctgtatgaaacccgcattgatctgagccagctgggcggcgat

SEQ ID NO: 20 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 21 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 22 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 23 - protein, 1404 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 24 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 25 - protein, 1368 aa, Streptococcus pyogenes [sequence omitted]

SEQ ID NO: 26 - protein, 1378 aa, Lactobacillus fermentum
MKEYHIGLDIGTSSIGWAVTDSQFKLMRIKGKTAIGVRLFEEGKTAAERRTFRTTRRRLKRRKWRLHYLDEIFAPHLQEVDENFLRRLKQSNIHPEDPTKNQAFIGKLLFPDLLKKNERGYPTLIKMRDELPVEQRAHYPVMNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKASDVASLVMAKTRGVNKPSVEGLSDPKKFNSNLATYLDLKSIVGDKVDDNRYQTDLENIIEWRSVFEDGEIFADKLTEVEWLTDEQRSALVKKRYKGWGRLSKKLLTGIVDENGQRIIDLMWNTDQNFKEIVDQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDNSLDNRVLTSRKENNKKSDQVPAKLYAAKMKPYWNQLLKQGLITQRKFENLTKDVDQNIKYRSLGFVKRQLVETRQVIKLTANILGSMYQEAGTEIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRLVDLYGAYTNGTSAFMTIIKFTGNKPKYKVIGIPTTSAASLKRAGKPGSESYNQELHRIIKSNPKVKKGFEIVVPHVSYGQLIVDGDCKFTLASPTVQHPATQLVLSKKSLETISSGYKILKDKPAIANERLIRVFDEVVGQMNRYFTIFDQRSNRQKVADARDKFLSLPTESKYEGAKKVQVGKTEVITNLLMGLHANATQGDLKVLGLATFGFFQSTTGLSLSEDTMIVYQSPTGLFERRICLKDI

SEQ ID NO: 27 - protein, 1368 aa, Streptococcus pyogenes [sequence omitted]

SEQ ID NO: 28 - protein, 1053 aa, Staphylococcus aureus
MGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKK

SEQ ID NO: 29 - protein, 1409 aa, Streptococcus thermophilus
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 30 - protein, 1402 aa, Lactobacillus crispatus
MKIKNYNLALTPSTSAVGHVEVDDDLNILEPVHHQKAIGVAKFGEGETAEARRLARSARRTTKRRANRINHYFNEIMKPEIDKVDPLMFDRIKQAGLSPLDERKEFRTVIFDRPNIASYYHNQFPTIWHLQKYLMITDEKADIRLIYWALHSLLKHRGHFFNTTPMSQFKPGKLNLKDDMLALDDYNDLEGLSFAVANSPEIEKVIKDRSMHKKEKIAELKKLIVNDVPDKDLAKRNNKIITQIVNAIMGNSFHLNFIFDMDLDKLTSKAWSFKLDDPELDTKFDAISGSMTDNQIGIFETLQKIYSAISLLDILNGSSNVVDAKNALYDKHKRDLNLYFKFLNTLPDEIAKTLKAGYTLYIGNRKKDLLAARKLLKVNVAKNFSQDDFYKLINKELKSIDKQGLQTRFSEKVGELVAQNNFLPVQRSSDNVFIPYQLNAITFNKILENQGKYYDFLVKPNPAKKDRKNAPYELSQLMQFTIPYYVGPLVTPEEQVKSGIPKTSRFAWMVRKDNGAITPWNFYDKVDIEATADKFIKRSIAKDSYLLSELVLPKHSLLYEKYEVFNELSNVSLDGKKLSGGVKQILFNEVFKKTNKVNTSRILKALAKHNIPGSKITGLSNPEEFTSSLQTYNAWKKYFPNQIDNFAYQQDLEKMIEWSTVFEDHKILAKKLDEIEWLDDDQKKFVANTRLRGWGRLSKRLLTGLKDNYGKSIMQRLETTKANFQQIVYKPEFREQIDKISQAAAKNQSLEDILANSYTSPSNRKAIRKTMSVVDEYIKLNHGKEPDKIFLMFQRSEQEKGKQTEARSKQLNRILSQLKADKSANKLFSKQLADEFSNAIKKSKYKLNDKQYFYFQQLGRDALTGEVIDYDELYKYTVLHIIPRSKLTDDSQNNKVLTKYKIVDGSVALKFGNSYSDALGMPIKAFWTELNRLKLIPKGKLLNLTTDFSTLNKYQRDGYIARQLVETQQIVKLLATIMQSRFKHTKIIEVRNSQVANIRYQFDYFRIKNLNEYYRGFDAYLAAVVGTYLYKVYPKARRLFVYGQYLKPKKTNQENQDMHLDSEKKSQGFNFLWNLLYGKQDQIFVNGTDVIAFNRKDLITKMNTVYNYKSQKISLAIDYHNGAMFKATLFPRNDRDTAKTRKLIPKKKDYDTDIYGGYTSNVDGYMLLAEIIKRDGNKQYGFYGVPSRLVSELDTLKKTRYTEYEEKLKEIIKPELGVDLKKIKKIKILKNKVPFNQVIIDKGSKFFITSTSYRWNYRQLILSAESQQTLMDLVVDPDFSNHKARKDARKNADERLIKVYEEILYQVKNYMPMFVELHRCYEKLVDAQKTFKSLKISDKAMVLNQILILLHSNATSPVLEKLGYHTRFTLGKKHNLISENAVLVTQSITGLKENHVSIKQML

SEQ ID NO: 31 - protein, 1385 aa, Thermoactinomyces candidus
MTNEKYSIGLDIGTSSIGFAVVNDNNRVIRVKGKNAIGVRLFDEGKAAADRRSFRTTRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLFLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQESKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 32 - protein, 1367 aa, Fusobacterium nucleatum
MKKQKFSDYYLGFDIGTNSVGWCVTDLDYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKIIDKNNIEKLEKIVCDSKKGLKDKEKEFKEIFNSDKQLVAIFKLSVGSSVSLNDLFDTDEYKKGEVEKEKISFREQIYEDDKPIYYSILGEKIELLDIAKTFYDFMVLNNILADSQYISEAKVKLYEEHKKDLKNLKYIIRKYNKGNYDKLFKDKNENNYSAYIGLNKEKSKKEVIEKSRLKIDDLIKNIKGYLPKVEEIEEKDKAIFNKILNKIELKTILPKQRISDNGTLPYQIHEAELEKILENQSKYYDFLNYEENGIITKDKLLMTFKFRIPYYVGPLNSYHKDKGGNSWIVRKEEGKILPWNFEQKVDIEKSAEEFIKRMTNKCTYLNGEDVIPKDTFLYSEYVILNELNKVQVNDEFLNEENKRKIIDELFKENKKVSEKKFKEYLLVKQIVDGTIELKGVKDSFNSNYISYIRFKDIFGEKLNLDIYKEISEKSILWKCLYGDDKKIFEKKIKNEYGDILTKDEIKKINTFKFNNWGRLSEKLLTGIEFINLETGECYSSVMDALRRTNYNLMELLSSKFTLQESINNENKEMNEASYRDLIEESYVSPSLKRAIFQTLKIYEEIRKITGRVPKKVFIEMARGGDESMKNKKIPARQEQLKKLYDSCGNDIANFSIDIKEMKNSLISYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEKKGQLFDLNPIKKGETSNEIISIKPKVYNGKDDKLNEKYGYYKSLNPAYFLYVEHKEKNKRIKSFERVNLVDVNNIKDEKSLVKYLIENKKLVEPRVIKKVYKRQVILINDYPYSIVTLDSNKLMDFENLKPLFLENKYEKILKNVIKFLEDNQGKSEENYKFIYLKKKDRYEKNETLESVKDRYNLEFNEMYDKFLEKLDSKDYKNYMNNKKYQELLDVKEKFIKLNLFDKAFTLKSFLDLFNRKTMADFSKVGLTKYLGKIQKISSNVLSKNELYLLEESVTGLFVKKIKL

SEQ ID NO: 33 - protein, 1286 aa, Enterococcus cecorum
RRKQRIQILQELLGEEVLKTDPGFFHRMKESRYVVEDKRTLDGKQVELPYALFVDKDYTDKEYYKQFPTINHLIVYLMTTSDTPDIRLVYLALHYYMKNRGNFLHSGDINNVKDINDILEQLDNVLETFLDGWNLKLKSYVEDIKNIYNRDLGRGERKKAFVNTLGAKTKAEKAFCSLISGGSTNLAELFDDSSLKEIETPKIEFASSSLEDKIDGIQEALEDRFAVIEAAKRLYDWKTLTDILGDSSSLAEARVNSYQMHHEQLLELKSLVKEYLDRKVFQEVFVSLNVANNYPAYIGHTKINGKKKELEVKRTKRNDFYSYVKKQVIEPIKKKVSDEAVLTKLSEIESLIEVDKYLPLQVNSDNGVIPYQVKLNELTRIFDNLENRIPVLRENRDKIIKTFKFRIPYYVGSLNGVVKNGKCTNWMVRKEEGKIYPWNFEDKVDLEASAEQFIRRMTNKCTYLVNEDVLPKYSLLYSKYLVLSELNNLRIDGRPLDVKIKQDIYENVFKKNRKVTLKKIKKYLLKEGIITDDDELSGLADDVKSSLTAYRDFKEKLGHLDLSEAQMENIILNITLFGDDKKLLKKRLAALYPFIDDKSLNRIATLNYRDWGRLSERFLSGITSVDQETGELRTIIQCMYETQANLMQLLAEPYHFVEAIEKENPKVDLESISYRIVNDLYVSPAVKRQIWQTLLVIKDIKQVMKHDPERIFIEMAREKQESKKTKSRKQVLSEVYKKAKEYEHLFEKLNSLTEEQLRSKKIYLYFTQLGKCMYSGEPIDFENLVSANSNYDIDHIYPQSKTIDDSFNNIVLVKKSLNAYKSNHYPIDKNIRDNEKVKTLWNTLVSKGLITKEKYERLIRSTPFSDEELAGFIARQLVETRQSTKAVAEILSNWFPESEIVYSKAKNVSNFRQDFEILKVRELNDCHHAHDAYLNIVVGNAYHTKFTNSPYRFIKNKANQEYNLRKLLQKVNKIESNGVVAWVGQSENNPGTIATVKKVIRRNTVLISRMVKEVDGQLFDLTLMKKGKGQVPIKSSDERLTDISKYGGYNKATGAYFTFVKSKKRGKVVRSFEYVPLHLSKQFENNNELLKEYIEKDRGLTDVEILIPKVLINSLFRYNGSLVRITGRGDTRLLLVHEQPLYVSNSFVQQLKSVSSYKLKKSENDNAKLTKTATEKLSNIDELYDGLLRKLDLPIYSYWFSSIKEYLVESRTKYIKLSIEEKALVIFEILHLFQSDAQVPNLKILGLSTKPSRIRIQKNLKDTDKMSIIHQSPSGIFEHEIELTSL

SEQ ID NO: 34 - protein, 1312 aa, Anaerostipes hadrus
MQNGFLGITVSSEQVGWAVTNPKYELERASRKDLWGVRLFDKAETAEDRRMFRTNRRLNQRKKNRIHYLRDIFHEEVNQKDPNFFQQLDESNFCEDDRTVEFNFDTNLYKNQFPTVYHLRKYLMETKDKPDIRLVYLAFSKFMKNRGHFLYKGNLGEVMDFENSMKGFCESLEKFNIDFPTLSDEQVKEVRDILCDHKIAKTVKKKNIITITKVKSKTAKAWIGLFCGCSVPVKVLFQDIDEEIVTDPEKISFEDASYDDYIANIEKGVGIYYEAIVSAKMLFDWSILNEILGDHQLLSDAMIAEYNKHHDDLKRLQKIIKGTGSRELYQDIFINDVSGNYVCYVGHAKTMSSADQKQFYTFLKNRLKNVNGISSEDAEWIDTEIKNGTLLPKQTKRDNSVIPHQLQLREFELILDNMQEMYPFLKENREKLLKIFNFVIPYYVGPLKGVVRKGESTNWMVPKKDGVIHPWNFDEMVDKEASAECFISRMTGNCSYLFNEKVLPKNSLLYETFEVLNELNPLKINGEPISVELKQRIYEQLFLTGKKVTKKSLTKYLIKNGYDKDIELSGIDNEFHSNLKSHIDFEDYDNLSDEEVEQIILRITVFEDKQLLKDYLNREFVKLSEDERKQICSLSYKGWGNLSEMLLNGITVTDSNGVEVSVMDMLWNTNLNLMQILSKKYGYKAEIEHYNKEHEKTIYNREDLMDYLNIPPAQRRKVNQLITIVKSLKKTYGVPNKIFFKISREHQDDPKRTSSRKEQLKYLYKSLKSEDEKHLMKELDELNDHELSNDKVYLYFLQKGRCIYSGKKLNLSRLRKSNYQNDIDYIYPLSAVNDRSMNNKVLTGIQENRADKYTYFPVDSEIQKKMKGFWMELVLQGFMTKEKYFRLSRENDFSKSELVSFIEREISDNQQSGRMIASVLQYYFPESKIVFVKEKLISSFKRDFHLISSYGHNHLQAAKDAYITIVVGNVYHTKFTMDPAIYFKNHKRKDYDLNRLFLENISRDGQIAWESGPYGSIQTVRKEYAQNHIAVTKRVVEVKGGLFKQMPLKKGHGEYPLKTNDPRFGNIAQYGGYTNVTGSYFVLVESMEKGKKRISLEYVPVYLHERLEDDPGHKLLKEYLVDHRKLNHPKILLAKVRKNSLLKIDGFYYRLNGRSGNALILTNAVELIMDDWQTKTANKISGYMKRRAIDKKARVYQNEFHIQELEQLYDFYLDKLKNGVYKNRKNNQAELIHNEKEQFMELKTEDQCVLLTEIKKLFVCSPMQADLTLIGGSKHTGMIAMSSNVTKADFAVIAEDPLGLRNKVIYSHKGEK

SEQ ID NO: 35 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 36 - protein, 1288 aa, Enterococcus faecalis
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 37 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 38 - protein, 1082 aa, Geobacillus thermodenitrificans
MKYKIGLDIGITSIGWAVINLDIPRIEDLGVRIFDRAENPKTGESLALPRRLARSARRRLRRRKHRLERIRRLFVREGILTKEELNKLFEKKHEIDVWQLRVEALDRKLNNDELARILLHLAKRRGFRSNRKSERTNKENSTMLKHIEENQSILSSYRTVAEMVVKDPKFSLHKRNKEDNYTNTVARDDLEREIKLIFAKQREYGNIVCTEAFEHEYISIWASQRPFASKDDIEKKVGFCTFEPKEKRAPKATYTFQSFTVWEHINKLRLVSPGGIRALTDDERRLIYKQAFHKNKITFHDVRTLLNLPDDTRFKGLLYDRNTTLKENEKVRFLELGAYHKIRKAIDSVYGKGAAKSFRPIDFDTFGYALTMFKDDTDIRSYLRNEYEQNGKRMENLADKVYDEELIEELLNLSFSKFGHLSLKALRNILPYMEQGEVYSTACERAGYTFTGPKKKQKTVLLPNIPPIANPVVMRALTQARKVVNAIIKKYGSPVSIHIELARELSQSFDERRKMQKEQEGNRKKNETAIRQLVEYGLTLNPTGLDIVKFKLWSEQNGKCAYSLQPIEIERLLEPGYTEVDHVIPYSRSLDDSYTNKVLVLTKENREKGNRTPAEYLGLGSERWQQFETFVLTNKQFSKKKRDRLLRLHYDENEENEFKNRNLNDTRYISRFLANFIREHLKFADSDDKQKVYTVNGRITAHLRSRWNFNKNREESNLHHAVDAAIVACTTPSDIARVTAFYQRREQNKELSKKTDPQFPQPWPHFADELQARLSKNPKESIKALNLGNYDNEKLESLQPVFVSRMPKRSITGAAHQETLRRYIGIDERSGKIQTVVKKKLSEIQLDKTGHFPMYGKESDPRTYEAIRQRLLEHNNDPKKAFQEPLYKPKKNGELGPIIRTIKIIDTTNQVIPLNDGKTVAYNSNIVRVDVFEKDGKYYCVPIYTIDMMKGILPNKAIEPNKPYSEWKEMTEDYTFRFSLYPNDLIRIEFPREKTIKTAVGEEIKIKDLFAYYQTIDSSNGGLSLVSHDNNFSLRSIGSRTLKRFEKYQVDVLGNIYKVRGEKRVGVASSSHSKAGETIRPL

SEQ ID NO: 39 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 40 - protein, 1368 aa, Streptococcus pyogenes
  misc_feature (10)..(10): Xaa can be any naturally occurring amino acid
  misc_feature (840)..(840): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 42 - protein, 1368 aa, Streptococcus pyogenes
  misc_feature (10)..(10): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 43 - protein, 1368 aa, Streptococcus pyogenes
  misc_feature (762)..(762): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIXMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 44 - protein, 1368 aa, Streptococcus pyogenes
  misc_feature (983)..(983): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHXAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 45 - protein, 1368 aa, Streptococcus pyogenes
  misc_feature (986)..(986): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHXAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 46 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 47 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIAMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 48 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHAAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHAAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 50 - protein, 1368 aa, Streptococcus pyogenes
  misc_feature (840)..(840): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 52 - protein, 1368 aa, Streptococcus pyogenes
  misc_feature (864)..(864): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 53 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1367 aa, Streptococcus pyogenes
  misc_feature (839)..(839): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 55 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 56 - protein, 1367 aa, Streptococcus pyogenes
  misc_feature (863)..(863): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 57 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 58 - protein, 1053 aa, Staphylococcus aureus; identical to SEQ ID NO: 28

SEQ ID NO: 59 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDAALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 60 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 61 - protein, 1087 aa, Geobacillus stearothermophilus
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 62 - protein, 1228 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 63 - protein, 1108 aa, Unknown
  Bacillushisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 64 - protein, 1307 aa, Unknown
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 65 - protein, 1307 aa, Artificial Sequence
  Synthetic
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMANSNAATGEDYINSPVRDLNGVCFDSRFQNPEWPMDADANGAYHIALKGQLLLNHLKESKDLKLQNGISNQDWLAYIQELRN

SEQ ID NO: 66 - protein, 1259 aa, Unknown
  Lachnospiraceae bacterium GAM79
MNYKTGLEDFIGKESLSKTLRNALIPTESTKIHMEEMGVIRDDELRAEKQQELKEIMDDYYRTFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDVAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTILASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 67 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 68 - protein, 1142 aa, Eubacterium rectale
MFSAKLISDILPEFVIHNNNYSASEKEEKTQVIKLFSRFATSFKDYFKNRANCFSANDISSSSCHRIVNDNAEIFFSNALVYRRIVKNLSNDDINKISGDMKDSLKEMSLEEIYSYEKYGEFITQEGISFYNDICGKVNLFMNLYCQKNKENKNLYKLRKLHKQILCIADTSYEVPYKFESDEEVYQSVNGFLDNISSKHIVERLRKIGENYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSTYEDISGFYREVELQGYKIDWTYISEKDIDLLQEKGQLYLFQIYNKDFSKKSSGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 69 - protein, 1259 aa, Unknown
  Clostridium sp. AF34-10BH
MNYKTGLEDFIGKESLSKTLRNALIPTESTKIHMEEMGVIRDDELRAEKQQELKEIMDDYYRAFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYLVDFYDRVLTQPGIEYYNGICGKINEHMNQFCQKNRINKNDFRMKKLHKQILCKKSSYYEIPFRFESDQEVYDALNEFIKTMKEKEIICRCVHLGQKCDDYDLGKIYISSNKYEQISNALYGSWDTIRKCIKEEYMDALPGKGEKKEEKAEAAAKKEEYRSIADIDKIISLYGSEMDRTISAKKCITEICDMAGQISTDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPVVHKKGSVLVNRSYTQTVGDKEIRVSIPEEYYTEIYNYLNHIGRGKLSTEAQRYLEERKIKSFTATKDIVKNYRYCCDHYFLHLPITINFKAKSDIAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTMLASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 70 - protein, 1108 aa, Unknown; identical to SEQ ID NO: 63
  Bacillushisashii

SEQ ID NO: 71 - protein, 1465 aa, Thermomonas hydrothermalis
MSEKTTQRAYTLRLNRASGECAVCQNNSCDCWHDALWATHKAVNRGAKAFGDWLLTLRGGLCHTLVEMEVPAKGNNPPQRPTDQERRDRRVLLALSWLSVEDEHGAPKEFIVATGRDSADDRAKKVEEKLREILEKRDFQEHEIDAWLQDCGPSLKAHIREDAVWVNRRALFDAAVERIKTLTWEEAWDFLEPFFGTQYFAGIGDGKDKDDAEGPARQGEKAKDLVQKAGQWLSARFGIGTGADFMSMAEAYEKIAKWASQAQNGDNGKATIEKLACALRPSEPPTLDTVLKCISGPGHKSATREYLKTLDKKSTVTQEDLNQLRKLADEDARNCRKKVGKKGKKPWADEVLKDVENSCELTYLQDNSPARHREFSVMLDHAARRVSMAHSWIKKAEQRRRQFESDAQKLKNLQERAPSAVEWLDRFCESRSMTTGANTGSGYRIRKRAIEGWSYVVQAWAEASCDTEDKRIAAARKVQADPEIEKFGDIQLFEALAADEAICVWRDQEGTQNPSILIDYVTGKTAEHNQKRFKVPAYRHPDELRHPVFCDFGNSRWSIQFAIHKEIRDRDKGAKQDTRQLQNRHGLKMRLWNGRSMTDVNLHWSSKRLTADLALDQNPNPNPTEVTRADRLGRAASSAFDHVKIKNVFNEKEWNGRLQAPRAELDRIAKLEEQGKTEQAEKLRKRLRWYVSFSPCLSPSGPFIVYAGQHNIQPKRSGQYAPHAQANKGRARLAQLILSRLPDLRILSVDLGHRFAAACAVWETLSSDAFRREIQGLNVLAGGSGEGDLFLHVEMTGDDGKRRTVVYRRIGPDQLLDNTPHPAPWARLDRQFLIKLQGEDEGVREASNEELWTVHKLEVEVGRTVPLIDRMVRSGFGKTEKQKERLKKLRELGWISAMPNEPSAETDEKEGEIRSISRSVDELMSSALGTLRLALKRHGNRARIAFAMTADYKPMPGGQKYYFHEAKEASKNDDETKRRDNQIEFLQDALSLWHDLFSSPDWEDNEAKKLWQNHIATLPNYQTPEEISAELKRVERNKKRKENRDKLRTAAKALAENDQLRQHLHDTWKERWESDDQQWKERLRSLKDWIFPRGKAEDNPSIRHVGGLSITRINTISGLYQILKAFKMRPEPDDLRKNIPQKGDDELENFNRRLLEARDRLREQRVKQLASRIIEAALGVGRIKIPKNGKLPKRPRTTVDTPCHAVVIESLKTYRPDDLRTRRENRQLMQWSSAKVRKYLKEGCELYGLHFLEVPANYTSRQCSRTGLPGIRCDDVPTGDFLKAPWWRRAINTAREKNGGDAKDRFLVDLYDHLNNLQSKGEALPATVRVPRQGGNLFIAGAQLDDTNKERRAIQADLNAAANIGLRALLDPDWRGRWWYVPCKDGTSEPALDRIEGSTAFNDVRSLPTGDNSSRRAPREIENLWRDPSGDSLESGTWSPTRAYWDTVQSRVIELLRRHAGLPTS

SEQ ID NO: 72 - protein, 1090 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 73 - protein, 1194 aa, Dsulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 74 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 75 - protein, 1082 aa, Geobacillus thermodenitrificans; identical to SEQ ID NO: 38

SEQ ID NO: 76 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 77 - protein, 1387 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYG

SEQ ID NO: 78 - protein, 1388 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQ

SEQ ID NO: 79 - protein, 1387 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYS

SEQ ID NO: 80 - protein, 1388 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGS

SEQ ID NO: 81 - protein, 1387 aa, Artificial Sequence
  Synthetic
KPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRD

SEQ ID NO: 82 - protein, 357 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 83 - protein, 341 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 84 - protein, 328 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 85 - protein, 120 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 86 - protein, 69 aa, Artificial Sequence
  Synthetic
KPIREQAENIIHLFTLTNLGAPAAFKYFDTTIDRKRYTSTKEVLDATLIHQSITGLYETRIDLSQLGGD

SEQ ID NO: 87 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 88 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 89 - protein, 677 aa, Unknown
  moloney murine leukemia virus
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSP

SEQ ID NO: 90 - protein, 560 aa, Unknown
  moloney murine leukemia virus
  misc_feature (229)..(229): Xaa can be any naturally occurring amino acid
AFPLERPDWDYTTQAGRNHLVHYRQLLLAGLQNAGRSPTNLAKVKGITQGPNESPSAFLERLKEAYRRYTPYDPEDPGQETNVSMSFIWQSAPDIGRKLGRLEDLKSKTLGDLVREAEKIFNKRETPEEREERIRRETEEKEERRRTVDEQKEKERDRRRHREMSKLLATVVIGQEQDRQEGERKRPQLDKDQCAYCKEKGHWAKDCPKKPRGPRGPRPQTSLLTLGDXGGQGQDPPPEPRITLKVGGQPVTFLVDTGAQHSVLTQNPGPLSDKSAWVQGATGGKRYRWTTDRKVHLATGKVTHSFLHVPDCPYPLLGRDLLTKLKAQIHFEGSGAQVVGPMGQPLQVLTLNIEDEYRLHETSKEPDVSLGFTWLSDFPQAWAESGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFR

SEQ ID NO: 91 - protein, 669 aa, Unknown
  Feline leukemia virus
TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLPVKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTLFDEALHSDLADFRVRYPALVLLQYVDDLLLAAATRTECLEGTKALLETLGNKGYRASAKKAQICLQEVTYLGYSLKDGQRWLTKARKEAILSIPVPKNSRQVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSKKLDTVASGWPPCLRMVAAIAILVKDAGKLTLGQPLTILTSHPVEALVRQPPNKWLSNARMTHYQAMLLDAERVHFGPTVSLNPATLLPLPSGGNHHDCLQILAETHGTRPDLTDQPLPDADLTWYTDGSSFIRNGEREAGAAVTTESEVIWAAPLPPGTSAQRAELIALTQALKMAEGKKLTVYTDSRYAFATTHVHGEIYRRRGLLTSEGKEIKNKNEILALLEALFLPKRLSIIHCPGHQKGDSPQAKGNRLADDTAKKAATETHSSLTVL

SEQ ID NO: 92 - protein, 559 aa, Unknown
  HIV-1
  misc_feature (280)..(280): Xaa can be any naturally occurring amino acid
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLXKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETFYVDGAANRETKLGKAGYVTNRGRQKVVTLTDTTNQKTELQAIYLALQDSGLEVNIVTDSQYALGIIQAQPDQSESELVNQIIEQLIKKEKVYLAWVPAHKGIGGNEQVDKLVSAGIRKV

SEQ ID NO: 93 - protein, 440 aa, Unknown
  HIV-1
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETF

SEQ ID NO: 94 - protein, 858 aa, Unknown
  rous sarcoma virus
TVALHLAIPLKWKPNHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLIVGQILEPLRLKHPSLRMLHYMDDLLLAASSHDGLEAAGEEVISTLERAGFTISPDKVQKEPGVQYLGYKLGSTYAAPVGLVAEPRIATLWDVQKLVGSLQWLRPALGIPPRLRGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFRDELPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAAQHHWATVIAVLGRPKAIKTDNGSCFTSKSTREWLARWGIAHTTGIPGNSQGQAMVERANRLLKDKIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDIAQKDEVTKKDEASPLFA

SEQ ID NO: 95 - protein, 675 aa, Unknown
  cauliflower mosaic virus
MMDHLLQKTQIQNQTEQVMNITNPNSIYIKGRLYFKGYKKIELHCFVDTGASLCIASKFVIPEEHWINAERPIMVKIADGSSITINKVCRDIDLIIAGEIFHIPTVYQQESGIDFIIGNNFCQLYEPFIQFTDRVIFTKDRTYPVHIAKLTRAVRVGTEGFLESMKKRSKTQQPEPVNISTNKIAILSEGRRLSEEKLFITQQRMQKIEELLEKVCSENPLDPNKTKQWMKASIKLSDPSKAIKVKPMKYSPMDREEFDKQIKELLDLKVIKPSKSPHMAPAFLVNNEAEKRRGKKRMVVNYKAMNKATVGDAYNLPNKDELLTLIRGKKIFSSFDCKSGFWQVLLDQDSRPLTAFTCPQGHYEWNVVPFGLKQAPSIFQRHMDEAFRVFRKFCCVYVDDILVFSNNEEDHLLHVAMILQKCNQHGIILSKKKAQLFKKKINFLGLEIDEGTHKPQGHILEHINKFPDTLEDKKQLQRFLGILTYASDYIPKLAQIRKPLQAKLKENVPWKWTKEDTLYMQKVKKNLQGFPPLHHPLPEEKLIIETDASDDYWGGMLKAIKINEGTNTELICRYASGSFKAAEKNYHSNDKETLAVINTIKKFSIYLTPVHFLIRTDNTHFKSFVNLNYKGDSKLGRNIRWQAWLSHYSFDVEHIKGTDNHFADFLSREFNRVNS

SEQ ID NO: 96 - protein, 366 aa, Unknown
  Klebsiella pneumonia
MKEKISKIDKNFYTDIFIKTSFQNEFEAGGVIPPIAKNQVSTISNKNKTFYSLAHSSPHYSIQTRIEKFLLKNIPLSASSFAFRKERSYLHYLEPHTQNVKYCHLDIVSFFHSIDVNIVRDTFSVYFSDEFLVKEKQSLLDAFMASVTLTAELDGVEKTFIPMGFKSSPSISNIIFRKIDILIQKFCDKNKITYTRYADDLLFSTKKENNILSSTFFINEISSILSINKFKLNKSKYLYKEGTISLGGYVIENILKDNSSGNIRLSSSKLNPLYKALYEIKKGSSSKHICIKVFNLKLKRFIYKKNKEKFEAKFYSSQLKNKLLGYRSYLLSFVIFHKKYKCINPIFLEKCVFLISEIESIMNRKF

SEQ ID NO: 97 - protein, 263 aa, Escherichia coli
MKITSNNVTAVINGKGWHSINWKKCHQHVKTIQTRIAKAACNQQWRTVGRLQRLLVRSFSARALAVKRVTENSGRKTPGVDGQIWSTPESKWEAIFKLRRKGYKPLPLKRVFIPKSNGKKRPLGIPVMLDRAMQALHLLGLEPVSETNADHNSYGFRPARCTADAIQQVCNMYSSRNASKWVLEGDIKGCFEHISHEWLLENIPMDKQILRNWLKAGIIEKSIFSKTLSGTPQGGIISPVLANMALDGLERLLQNRFGRNRLI

SEQ ID NO: 98 - protein, 438 aa, Streptococcus pyogenes
MSKIKINYEKYHIKPFPHFDQRIKVNKKVKENLQNPFYIAAHSFYPFIHYKKISYKFKNGTLSSPKERDIFYSGHMDGYIYKHYGEILNHKYNNTCIGKGIDHVSLAYRNNKMGKSNIHFAAEVINFISEQQQAFIFVSDFSSYFDSLDHAILKEKLIEVLEEQDKLSKDWWNVFKHITRYNWVEKEEVISDLECTKEKIARDKKSRERYYTPAEFREFRKRVNIKSNDTGVGIPQGTAISAVLANVYAIDLDQKLNQYALKYGGIYRRYSDDIIMVLPMTSDGQDPSNDHVSFIKSVVKRNKVTMGDSKTSVLYYANNNIYEDYQRKRESKMDYLGFSFDGMTVKIREKSLFKYYHRTYKKINSINWASVKKEKKVGRKKLYLLYSHLGRNYKGHGNFISYCKKAHAVFEGNKKIESLINQQIKRHWKKIQKRLVDV

SEQ ID NO: 99 - protein, 426 aa, Eubacterium rectale
DTSNLMEQILSSDNLNRAYLQVVRNKGAEGVDGMKYTELKEHLAKNGETIKGQLRTRKYKPQPARRVEIPKPDGGVRNLGVPTVTDRFIQQAIAQVLTPIYEEQFHDHSYGFRPNRCAQQAILTALNIMNDGNDWIVDIDLEKFFDTVNHDKLMTLIGRTIKDGDVISIVRKYLVSGIMIDDEYEDSIVGTPQGGNLSPLLANIMLNELDKEMEKRGLNFVRYADDCIIMVGSEMSANRVMRNISRFIEEKLGLKVNMTKSKVDRPSGLKYLGFGFYFDPRAHQFKAKPHAKSVAKFKKRMKELTCRSWGVSNSYKVEKLNQLIRGWINYFKIGSMKTLCKELDSRIRYRLRMCIWKQWKTPQNQEKNLVKLGIDRNTARRVAYTGKRIAYVCNKGAVNVAISNKRLASFGLISMLDYYIEKCVTC

SEQ ID NO: 100 - protein, 412 aa, Geobacillus stearothermophilus
ALLERILARDNLITALKRVEANQGAPGIDGVSTDQLRDYIRAHWSTIHAQLLAGTYRPAPVRRVEIPKPGGGTRQLGIPTVVDRLIQQAILQELTPIFDPDFSSSSFGFRPGRNAHDAVRQAQGYIQEGYRYVVDMDLEKFFDRVNHDILMSRVARKVKDKRVLKLIRAYLQAGVMIEGVKVQTEEGTPQGGPLSPLLANILLDDLDKELEKRGLKFCRYADDCNIYVKSLRAGQRVKQSIQRFLEKTLKLKVNEEKSAVDRPWKRAFLGFSFTPERKARIRLAPRSIQRLKQRIRQLTNPNWSISMPERIHRVNQYVMGWIGYFRLVETPSVLQTIEGWIRRRLRLCQWLQWKRVRTRIRELRALGLKETAVMEIANTRKGAWRTTKTPQLHQALGKTYWTAQGLKSLTQR

SEQ ID NO: 101 - RNA, 126 nt, Artificial Sequence
  Synthetic
uacaccaucacggucuaugcguuuuagagcuagaaauagcaaguuaaaauaaggcuaguccguuaucaacuugaaaaaguggcaccgagucggugcuaucuucgccccaugcauagaccgugaugg

SEQ ID NO: 102 - RNA, 126 nt, Artificial Sequence
  Synthetic
cgcgucgcgcucgucagaucguuuuagagcuagaaauagcaaguuaaaauaaggcuaguccguuaucaacuugaaaaaguggcaccgagucggugcuuuccgccuaccugcaucugacgagcgcga

SEQ ID NO: 103 - RNA, 132 nt, Artificial Sequence
  Synthetic
aucggagaauacaugaacauguuuuagagcuagaaauagcaaguuaaaauaaggcuaguccguuaucaacuugaaaaaguggcaccgagucggugccggagaauacaugaacaucggacccgcgcuaucuuc

SEQ ID NO: 104 - RNA, 126 nt, Artificial Sequence
  Synthetic
  misc_feature (107)..(109): n is a, c, g, or u
uacaccaucacggucuaugcguuuuagagcuagaaauagcaaguuaaaauaaggcuaguccguuaucaacuugaaaaaguggcaccgagucggugcuaucuucgccnnnugcauagaccgugaugg

SEQ ID NO: 105 - RNA, 126 nt, Artificial Sequence
  Synthetic
uacaccaucacggucuaugcguuuuagagcuagaaauagcaaguuaaaauaaggcuaguccguuaucaacuugaaaaaguggcaccgagucggugcgggggggggggggugcauagaccgugaugg

SEQ ID NO: 106 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSP

SEQ ID NO: 107 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSP

SEQ ID NO: 108 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 109 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQKARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 110 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLRRFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 111 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSKGKEIKNKDEILALLKALFLPKRLSIIHCPGHQKGHSAEARGNRMADQAARKAAITETPDTSTLLIENSSP

SEQ ID NO: 112 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 113 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVIGAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 114 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSKARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 115 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 116 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 117 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAQLIALTQALKMAEGKKLNVYTNSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 118 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLRRFLGTAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 119 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSKGKEIKNKDEILALLKALFLPKRLSIIHCPGHQKGHSAEARGNRMADQAARKAAITETPDTSTLLIENSSP

SEQ ID NO: 120 - protein, 677 aa, Artificial Sequence
  Synthetic
TLNIEDEYRLHETSKEPDVSLGSTWLSDFPQAWAETGGMGLAVRQAPLIILLKATSTPVSIKQYPMKQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPALFDEALRRDLADFRIQHPDLILLQYVDDLLLAATSELDCQQGTRALLQTLGNLGYRASAKKAQICQKQVKYLGYLLKEGQRWLTEARKETVMGQPTPKTPRQLRKFLGTAGNCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVIGAPHAVEALVKQPPDRWLSKARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTNSRYAFATAHIQGEIYRRRGLLTSEGKEIKNKDEILALLKALFLPKRLSIIHCPGHQKGHSAEARGNRMANQAARKAAITETPDTSTLLIENSSP

SEQ ID NO: 121 - protein, 677 aa, Artificial Sequence
  Synthetic
TLNIEDEYRLHETSKEPDVSLGSTWLSDFPQAWAETGGMGLAVRQAPLIILLKATSTPVSIKQYPMKQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPALFNEALRRDLADFRIQHPDLILLQYVDDLLLAATSELDCQQGTRALLQTLGNLGYRASAKKAQICQKQVKYLGYLLKEGQRWLTEARKETVMGQPTPKTPRQLRKFLGTAGNCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVIGAPHAVEALVKQPPDRWLSKARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTNSRYAFATAHIQGEIYRRRGLLTSEGKEIKNKDEILALLKALFLPKRLSIIHCPGHQKGHSAEARGNRMANQAARKAAITETPDTSTLLIENSSP

SEQ ID NO: 122 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 123 - protein, 2117 aa, Artificial Sequence
  Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 124 - protein, 19 aa, Artificial Sequence
  Synthetic
MKRTADGSEFESPKKKRKV

SEQ ID NO: 125 - protein, 17 aa, Artificial Sequence
  Synthetic
KRTADGSEFEPKKKRKV

SEQ ID NO: 126 - protein, 1367 aa, Streptococcus pyogenes; identical to SEQ ID NO: 55

SEQ ID NO: 127 - protein, 33 aa, Artificial Sequence
  Synthetic
SGGSSGGSSGSETPGTSESATPESSGGSSGGSS

SEQ ID NO: 128 - protein, 677 aa, Unknown; identical to SEQ ID NO: 89
  moloney murine leukemia virus

SEQ ID NO: 129 - protein, 328 aa, Unknown
  Bordetella phage
MGKRHRNLIDQITTWENLLDAYRKTSHGKRRTWGYLEFKEYDLANLLALQAELKAGNYERGPYREFLVYEPKPRLISALEFKDRLVQHALCNIVAPIFEAGLLPYTYACRPDKGTHAGVCHVQAELRRTRATHFLKSDFSKFFPSIDRAALYAMIDKKIHCAATRRLLRVVLPDEGVGIPIGSLTSQLFANVYGGAVDRLLHDELKQRHWARYMDDIVVLGDDPEELRAVFYRLRDFASERLGLKISHWQVAPVSRGINFLGYRIWPTHKLLRKSSVKRAKRKVANFIKHGEDESLQRFLASWSGHAQWADTHNLFTWMEEQYGIACH

SEQ ID NO: 130 - protein, 1367 aa, Streptococcus pyogenes; identical to SEQ ID NO: 55

SEQ ID NO: 131 - DNA, 76 bp, Artificial Sequence
  Synthetic
gttttagagctagaaatagcaagttaaaataaggctagtccgttatcaacttgaaaaagtggcaccgagtcggtgc

SEQ ID NO: 132 - protein, 677 aa, Unknown; identical to SEQ ID NO: 89
  moloney murine leukemia virus

SEQ ID NO: 133 - protein, 21 aa, Artificial Sequence
  Synthetic
SGGSKRTADGSEFEPKKKRKV

SEQ ID NO: 134 - protein, 2117 aa, Artificial Sequence
  Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 135 - skipped

SEQ ID NO: 136 - protein, 19 aa, Artificial Sequence
  Synthetic
NLSKRPAAIKKAGQAKKKK

SEQ ID NO: 137 - protein, 1367 aa, Streptococcus pyogenes; identical to SEQ ID NO: 55

SEQ ID NO: 138 - skipped

SEQ ID NO: 139 - protein, 677 aa, Artificial Sequence; identical to SEQ ID NO: 122
  Synthetic

SEQ ID NO: 140 - skipped

SEQ ID NO: 141 - protein, 1367 aa, Streptococcus pyogenes; identical to SEQ ID NO: 55

SEQ ID NO: 142 - skipped

SEQ ID NO: 143 - protein, 677 aa, Artificial Sequence; identical to SEQ ID NO: 122
  Synthetic

SEQ ID NO: 144 - skipped

SEQ ID NO: 145 - protein, 2117 aa, Artificial Sequence
  Synthetic
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

SEQ ID NO: 146 - skipped

SEQ ID NO: 147 - protein, 1367 aa, Streptococcus pyogenes; identical to SEQ ID NO: 55

SEQ ID NO: 148 - skipped

SEQ ID NO: 149 - protein, 677 aa, Unknown; identical to SEQ ID NO: 89
  moloney murine leukemia virus

SEQ ID NO: 150 - protein, 2144 aa, Artificial Sequence
  Synthetic
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSSGGSSGSETPGTSESATPESAGSYPYDVPDYAGSAAPAAKKKKLDGSGSGGSSGGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKRTADGSEFEPKKKRKV

SEQ ID NO: 151-152 - skipped (2 entries)

SEQ ID NO: 153 - protein, 1367 aa, Streptococcus pyogenes; identical to SEQ ID NO: 55

SEQ ID NO: 154 - protein, 2529 aa, Artificial Sequence
  Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGKSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 155-156 - skipped (2 entries)

SEQ ID NO: 157 - protein, 1367 aa, Streptococcus pyogenes; identical to SEQ ID NO: 55

SEQ ID NO: 158 - skipped

SEQ ID NO: 159 - protein, 677 aa, Artificial Sequence; identical to SEQ ID NO: 122
  Synthetic

SEQ ID NO: 160 - skipped

SEQ ID NO: 161 - protein, 379 aa, Artificial Sequence
  Synthetic
GIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 162 - protein, 1803 aa, Artificial Sequence
  Synthetic
MKRTADGSEFESPKKKRKVGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 163 - protein, 2117 aa, Artificial Sequence
  Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 164 - protein, 2117 aa, Unknown
  moloney murine leukemia virus
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 165 - protein, 150 aa, Artificial Sequence
  Synthetic
  misc_feature (6)..(150): may be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 166 - protein, 30 aa, Artificial Sequence
  Synthetic
  misc_feature (2)..(30): may be absent
GGGGGGGGGGGGGGGGGGGGGGGGGGGGGG

SEQ ID NO: 167 - protein, 150 aa, Artificial Sequence
  Synthetic
  misc_feature (6)..(150): may be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 168 - protein, 90 aa, Artificial Sequence
  Synthetic
  misc_feature (4)..(90): may be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 169 - protein, 120 aa, Artificial Sequence
  Synthetic
  misc_feature (5)..(120): may be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 170 - protein, 60 aa, Artificial Sequence
  Synthetic
  misc_feature (1)..(1): Xaa can be any naturally occurring amino acid
  misc_feature (3)..(3): Xaa can be any naturally occurring amino acid
  misc_feature (3)..(60): may be absent
  misc_feature (5)..(5): Xaa can be any naturally occurring amino acid
  misc_feature (7)..(7): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (31)..(31): Xaa can be any naturally occurring amino acid
  misc_feature (33)..(33): Xaa can be any naturally occurring amino acid
  misc_feature (35)..(35): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(43): Xaa can be any naturally occurring amino acid
  misc_feature (45)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (55)..(55): Xaa can be any naturally occurring amino acid
  misc_feature (57)..(57): Xaa can be any naturally occurring amino acid
  misc_feature (59)..(59): Xaa can be any naturally occurring amino acid
XPXPXPXPXPXPXPXPXPXPXPXPXPXPXPXPXPXPXPXPXPXPXPXPXPXPXPXPXPXP

SEQ ID NO: 171 - protein, 16 aa, Artificial Sequence
  Synthetic
SGSETPGTSESATPES

SEQ ID NO: 172 - protein, 32 aa, Artificial Sequence
  Synthetic
SGGSSGGSSGSETPGTSESATPESSGGSSGGS

SEQ ID NO: 173 - protein, 10 aa, Artificial Sequence
  Synthetic
SGGSGGSGGS

SEQ ID NO: 174 - protein, 4 aa, Artificial Sequence
  Synthetic
SGGS

SEQ ID NO: 175 - protein, 60 aa, Artificial Sequence
  Synthetic
SGGSSGGSSGSETPGTSESATPESAGSYPYDVPDYAGSAAPAAKKKKLDGSGSGGSSGGS

SEQ ID NO: 176 - protein, 21 aa, Artificial Sequence
  Synthetic
GGSGGSGGSGGSGGSGGSGGS

SEQ ID NO: 177 - DNA, 17 bp, Artificial Sequence
  Synthetic
cggtggaccgatgatct

SEQ ID NO: 178 - DNA, 17 bp, Artificial Sequence
  Synthetic
gccacctggctactaga

SEQ ID NO: 179 - DNA, 17 bp, Artificial Sequence
  Synthetic
agatcatcggtccaccg

SEQ ID NO: 180 - DNA, 17 bp, Artificial Sequence
  Synthetic
tctagtagccaggtggc

SEQ ID NO: 181 - DNA, 136 bp, Artificial Sequence
  Synthetic
ggcccagactgagcacgtgagttttagagctagaaatagcaagttaaaataaggctagtccgttatcaacttgaaaaagtggcaccgagtcggtgctctgccatcacggtggaccgatgatctcgtgctcagtctg

SEQ ID NO: 182 - DNA, 154 bp, Artificial Sequence
  Synthetic
ggcactgcggctggaggtgggttttagagctagaaatagcaagttaaaataaggctagtccgttatcaacttgaaaaagtggcaccgagtcggtgcacacagcaccagagtctccgctttaacccccagccacctggctactagacctccagcc

SEQ ID NO: 183 - DNA, 141 bp, Artificial Sequence
  Synthetic
gcatggtgcacctgactcctggttttagagctagaaatagcaagttaaaataaggctagtccgttatcaacttgaaaaagtggcaccgagtcggtgcagacttctcttcaggccacctggctactagagagtcaggtgcac

SEQ ID NO: 184-189 - skipped (6 entries)

SEQ ID NO: 190 - protein, 20 aa, Artificial Sequence
  Synthetic
AVKRPAATKKAGQAKKKKLD

SEQ ID NO: 191 - protein, 25 aa, Artificial Sequence
  Synthetic
MSRRRKANPTKLSENAKKLAKEVEN

SEQ ID NO: 192 - protein, 9 aa, Artificial Sequence
  Synthetic
PAAKRVKLD

SEQ ID NO: 193 - protein, 9 aa, Artificial Sequence
  Synthetic
KLKIKRPVK

SEQ ID NO: 194 - protein, 8 aa, Artificial Sequence
  Synthetic
VSRKRPRP

SEQ ID NO: 195 - protein, 10 aa, Artificial Sequence
  Synthetic
EGAPPAKRAR

SEQ ID NO: 196 - protein, 12 aa, Artificial Sequence
  Synthetic
PPQPKKKPLDGE

SEQ ID NO: 197 - skipped

SEQ ID NO: 198 - protein, 380 aa, Homo sapiens; identical to SEQ ID NO: 7

SEQ ID NO: 199 - protein, 380 aa, Artificial Sequence
  Synthetic
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVRAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 200 - protein, 380 aa, Artificial Sequence
  Synthetic
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGAPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 201 - protein, 380 aa, Artificial Sequence
  Synthetic
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSARRKEPEPKGSTKKKAKTGAAGKFKRGK

SEQ ID NO: 202 - protein, 908 aa, Artificial Sequence
  Synthetic
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQRFNRWNETSCNSSPQLLVTKKLAHCSVCSHPGSPKDHERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 203 - protein, 1186 aa, Artificial Sequence
  Synthetic
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 204 - DNA, 23 bp, Artificial Sequence
  Synthetic
  misc_feature (1)..(8): n is a, c, g, or t
  misc_feature (9)..(20): n is a, c, g, or t
  misc_feature (21)..(21): n is a, c, g, or t
nnnnnnnnnnnnnnnnnnnnngg

SEQ ID NO: 205 - DNA, 15 bp, Artificial Sequence
  Synthetic
  misc_feature (1)..(12): n is a, c, g, or t
  misc_feature (13)..(13): n is a, c, g, or t
nnnnnnnnnnnnngg

SEQ ID NO: 206 - DNA, 23 bp, Artificial Sequence
  Synthetic
  misc_feature (1)..(9): n is a, c, g, or t
  misc_feature (10)..(20): n is a, c, g, or t
  misc_feature (21)..(22): n is a, c, g, or t
nnnnnnnnnnnnnnnnnnnnngg

SEQ ID NO: 207 - DNA, 14 bp, Artificial Sequence
  Synthetic
  misc_feature (1)..(11): n is a, c, g, or t
  misc_feature (12)..(12): n is a, c, g, or t
nnnnnnnnnnnngg

SEQ ID NO: 208 - DNA, 27 bp, Artificial Sequence
  Synthetic
  misc_feature (1)..(9): n is a, c, g, or t
  misc_feature (10)..(20): n is a, c, g, or t
  misc_feature (21)..(22): n is a, c, g, or t
nnnnnnnnnnnnnnnnnnnnnnagaaw

SEQ ID NO: 209 - DNA, 19 bp, Artificial Sequence
  Synthetic
  misc_feature (1)..(12): n is a, c, g, or t
  misc_feature (13)..(14): n is a, c, g, or t
nnnnnnnnnnnnnnagaaw

SEQ ID NO: 210 - DNA, 27 bp, Artificial Sequence
  Synthetic
  misc_feature (1)..(9): n is a, c, g, or t
  misc_feature (10)..(20): n is a, c, g, or t
  misc_feature (21)..(22): n is a, c, g, or t
nnnnnnnnnnnnnnnnnnnnnnagaaw

SEQ ID NO: 211 - DNA, 18 bp, Artificial Sequence
  Synthetic
  misc_feature (1)..(11): n is a, c, g, or t
  misc_feature (12)..(13): n is a, c, g, or t
nnnnnnnnnnnnnagaaw

SEQ ID NO: 212 - DNA, 25 bp, Artificial Sequence
  Synthetic
  misc_feature (1)..(8): n is a, c, g, or t
  misc_feature (9)..(20): n is a, c, g, or t
  misc_feature (21)..(21): n is a, c, g, or t
  misc_feature (24)..(24): n is a, c, g, or t
nnnnnnnnnnnnnnnnnnnnnggng

SEQ ID NO: 213 - DNA, 17 bp, Artificial Sequence
  Synthetic
  misc_feature (1)..(12): n is a, c, g, or t
  misc_feature (13)..(14): n is a, c, g, or t
  misc_feature (16)..(16): n is a, c, g, or t
nnnnnnnnnnnnnggng

SEQ ID NO: 214-215 - skipped (2 entries)

SEQ ID NO: 216 - DNA, 125 bp, Artificial Sequence
  Synthetic
  misc_feature (1)..(8): n is a, c, g, or t
nnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 217 - DNA, 121 bp, Artificial Sequence
  Synthetic
  misc_feature (1)..(18): n is a, c, g, or t
nnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 218 - DNA, 109 bp, Artificial Sequence
  Synthetic
  misc_feature (1)..(20): n is a, c, g, or t
nnnnnnnnnnnnnnnnnnnngtttttgtactctcagaaatgcagaagctacaaagataaggcttcatgccgaaatcaacaccctgtcattttatggcagggtgtttttt

SEQ ID NO: 219 - DNA, 102 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtggcaccgagtcggtgctttttt

SEQ ID NO: 220 - DNA, 88 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtgttttttt

SEQ ID NO: 221 - DNA, 76 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcatttttttt

SEQ ID NO: 222 - RNA, 82 nt, Artificial Sequence
  Synthetic
guuuuagagcuagaaauagcaaguuaaaauaaaggcuaguccguuaucaacuugaaaaaguggcaccgagucggugcuuuuu

SEQ ID NO: 223 - DNA, 905 bp, Artificial Sequence
  Synthetic
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgttcactgccgtataggcagggcccagactgagcacgtgagttttagagctagaaatagcaagttaaaataaggctagtccgttatcaacttgaaaaagtgggaccgagtcggtcctctgccatcaaagcgtgctcagtctgttttagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgact

SEQ ID NO: 224 - DNA, 942 bp, Artificial Sequence
  Synthetic
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgttcactgccgtataggcagggcccagactgagcacgtgagttttagagctagaaatagcaagttaaaataaggctagtccgttatcaacttgaaaaagtgggaccgagtcggtcctctgccatcaaagcgtgctcagtctgttttgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaa

SEQ ID NO: 225 - DNA, 1370 bp, Artificial Sequence
  Synthetic
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgttcactgccgtataggcagggcccagactgagcacgtgagttttagagctagaaatagcaagttaaaataaggctagtccgttatcaacttgaaaaagtgggaccgagtcggtcctctgccatcaaagcgtgctcagtctgttttgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaaacacactgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaatctctctgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaa

SEQ ID NO: 226 - DNA, 807 bp, Artificial Sequence
  Synthetic
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcgttcactgccgtataggcagggcccagactgagcacgtgagttttagagctagaaatagcaagttaaaataaggctagtccgttatcaacttgaaaaagtgggaccgagtcggtcctctgccatcaaagcgtgctcagtctgtttgtttcaaaagtagactgtacgctaagggtcatatctttttttgtttggtttgtgtcttggttggcgtcttaaa

SEQ ID NO: 227 - DNA, 743 bp, Artificial Sequence
  Synthetic
ctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcaccacgaaggagttcccgtgccctgggagcgggttcaggaccgctgatcggaagtgagaatcccagctgtgtgtcagggctggaaagggctcgggagtgcgcggggcaagtgaccgtgtgtgtaaagagtgaggcgtatgaggctgtgtcggggcagaggcccaagatctcagttcactgccgtataggcagggcccagactgagcacgtgagttttagagctagaaatagcaagttaaaataaggctagtccgttatcaacttgaaaaagtgggaccgagtcggtcctctgccatcaaagcgtgctcagtctgtttcagcaagttcagagaaatctgaacttgctggatttttggagcagggagatggaataggagcttgctccgtccactccacgcatcgacctggtattgcagtacctccaggaacggtgcacccactttctggagtttcaaaagtagactgtacgctaagggtcatatctttttttgtttggtttgtgtcttggttggcgtcttaaa

SEQ ID NO: 228 - DNA, 141 bp, Artificial Sequence
  Synthetic
ggcccagactgagcacgtgagttttagagctagctcatgaaaatgagctagcaagttaaaataaggctagtccgttatcaacttgaaaaagtgggaccgagtcggtcctctgccatcaaagcgtgctcagtctgttttttt

SEQ ID NO: 229 - DNA, 129 bp, Artificial Sequence
  Synthetic
ggcccagactgagcacgtgagtttgagagctagaaatagcaagtttaaataaggctagtccgttatcaacttgaaaaagtgggaccgagtcggtcctctgccatcaaagcgtgctcagtctgttttttt

SEQ ID NO: 230 - DNA, 197 bp, Artificial Sequence
  Synthetic
ggcccagactgagcacgtgagttttagagctagaaatagcaagttaaaataaggctagtccgttatcaacttgaaaaagtgggaccgagtcggtcctctgccatcaaagcgtgctcagtctgggccggcatggtcccagcctcctcgctggcgccggctgggcaacatgcttcggcatggcgaatgggacttttttt

SEQ ID NO: 231 - DNA, 171 bp, Artificial Sequence
  Synthetic
ggtgggagacgtcccaccggcccagactgagcacgtgagttttagagctagaaatagcaagttaaaataaggctagtccgttatcaacttgaaaaagtgggaccgagtcggtcctctgccatcaaagcttcgaccgtgctcagtctggtgggagacgtcccaccttttttt

SEQ ID NO: 232 - DNA, 180 bp, Artificial Sequence
  Synthetic
gagcagcatggcgtcgctgctcacggcccagactgagcacgtgagttttagagctagaaatagcaagttaaaataaggctagtccgttatcaacttgaaaaagtgggaccgagtcggtcctctgccatcaaagcttcgaccgtgctcagtctccatcagttgacaccctgaggttttttt

SEQ ID NO: 233 - DNA, 188 bp, Artificial Sequence
  Synthetic
gcagacctaagtggugacatatggtctgggcccagactgagcacgtgagttttagagctauacgtagcaagttaaaataaggctagtccgttatcaacttuacgaagtgggaccgagtcggtcctctgccatcaaagcttcgaccgtgctcagtctgcatgcgattagaaataatcgcatgttttttt

SEQ ID NO: 234 - DNA, 125 bp, Artificial Sequence
  Synthetic
tctgccatcaaagctgcgaccgtgctcagtctggtgggagacgtcccaccggccggcatggtcccagcctcctcgctggcgccggctgggcaacatgcttcggcatggcgaatgggacttttttt

SEQ ID NO: 235 - protein, 328 aa, Unknown; identical to SEQ ID NO: 129
  Bordetella phage

SEQ ID NO: 236 - protein, 128 aa, Unknown
  Bordetella phage
MEPIEEATKCYDQMLIVERYERVISYLYPIAQSIPRKHGVAREMFLKCLLGQVELFIVAGKSNQVSKLYAADAGLAMLRFWLRFLAGIQKPHAMTPHQVETAQVLIAEVGRILGSWIARVNRKGQAGK

SEQ ID NO: 237 - RNA, 169 nt, Unknown
  Bordetella phage
accuucuugcauggcucugccaacgcuacggcuuggcgggcuggccuuuccucaauagguggucagccgguucuguccugcuucggcgaacacguuacacgguucggcaaaacgucgauuacugaaaauggaaaggcggggccgacuucaagggcaggcugggaaauaa

SEQ ID NO: 238 - RNA, 149 nt, Artificial Sequence
  Synthetic
accuucuugcauggcucugccaacgcuacggcuuggcgggcuggccuuuccucaauagguggucagccgguucuguccugcuucggcgaacacguuacacgguucggcaaaacgucgauuacugaaaauggaaaggcggggccgacuuc

SEQ ID NO: 239 - RNA, 85 nt, Artificial Sequence
  Synthetic
accuucuugcauggcucugccaacgcuacggcuuggcgggcuggccuuuccucaauagguggucaaagggcaggcugggaaauaa

SEQ ID NO: 240 - RNA, 160 nt, Artificial Sequence
  Synthetic
cauggcucugccaacgcuacggcuuggcgggcuggccuuuccucaauagguggucagccgguucuguccugcuucggcgaacacguuacacgguucggcaaaacgucgauuacugaaaauggaaaggcggggccgacuucaagggcaggcugggaaauaa

SEQ ID NO: 241 - RNA, 140 nt, Artificial Sequence
  Synthetic
cauggcucugccaacgcuacggcuuggcgggcuggccuuuccucaauagguggucagccgguucuguccugcuucggcgaacacguuacacgguucggcaaaacgucgauuacugaaaauggaaaggcggggccgacuuc

SEQ ID NO: 242 - RNA, 76 nt, Artificial Sequence
  Synthetic
cauggcucugccaacgcuacggcuuggcgggcuggccuuuccucaauagguggucaaagggcaggcugggaaauaa

SEQ ID NO: 243 - RNA, 56 nt, Artificial Sequence
  Synthetic
cauggcucugccaacgcuacggcuuggcgggcuggccuuuccucaauaggugguca

SEQ ID NO: 244 - RNA, 169 nt, Artificial Sequence
  Synthetic
accuucuugcauggcucugccaacgcuacggcuuggcgggcuggccuuuccucaauagaugagccgccgguucuguccugcuucggcgaacacguuacacgguucggcaaaacgucgauuacugaaaauggaaaggcggggccgacuucaagggcaggcugggaaauaa

SEQ ID NO: 245 - protein, 15 aa, Artificial Sequence
  Synthetic
GLNDIFEAQKIEWHE

SEQ ID NO: 246 - protein, 4 aa, Artificial Sequence
  Synthetic
EPEA

SEQ ID NO: 247 - protein, 26 aa, Artificial Sequence
  Synthetic
KRRWKKNFIAVSAANRFKKISSSGAL

SEQ ID NO: 248 - protein, 6 aa, Artificial Sequence
  Synthetic
EEEEEE

SEQ ID NO: 249 - protein, 13 aa, Artificial Sequence
  Synthetic
GAPVPYPDPLEPR

SEQ ID NO: 250 - protein, 8 aa, Artificial Sequence
  Synthetic
DYKDDDDK

SEQ ID NO: 251 - protein, 9 aa, Artificial Sequence
  Synthetic
YPYDVPDYA

SEQ ID NO: 252 - protein, 1 aa, Artificial Sequence
  Synthetic
H

SEQ ID NO: 253 - protein, 2 aa, Artificial Sequence
  Synthetic
HH

SEQ ID NO: 254 - protein, 3 aa, Artificial Sequence
  Synthetic
HHH

SEQ ID NO: 255 - protein, 4 aa, Artificial Sequence
  Synthetic
HHHH

SEQ ID NO: 256 - protein, 5 aa, Artificial Sequence
  Synthetic
HHHHH

SEQ ID NO: 257 - protein, 6 aa, Artificial Sequence
  Synthetic
HHHHHH

SEQ ID NO: 258 - protein, 7 aa, Artificial Sequence
  Synthetic
HHHHHHH

SEQ ID NO: 259 - protein, 8 aa, Artificial Sequence
  Synthetic
HHHHHHHH

SEQ ID NO: 260 - protein, 9 aa, Artificial Sequence
  Synthetic
HHHHHHHHH

SEQ ID NO: 261 - protein, 10 aa, Artificial Sequence
  Synthetic
HHHHHHHHHH

SEQ ID NO: 262 - protein, 25 aa, Artificial Sequence
  Synthetic
  misc_feature (2)..(25): may be absent
HHHHHHHHHHHHHHHHHHHHHHHHH

SEQ ID NO: 263 - protein, 10 aa, Artificial Sequence
  Synthetic
EQKLISEEDL

SEQ ID NO: 264 - protein, 18 aa, Artificial Sequence
  Synthetic
TKENPRSNQEESYDDNES

SEQ ID NO: 265 - protein, 9 aa, Artificial Sequence
  Synthetic
TETSQVAPA

SEQ ID NO: 266 - protein, 15 aa, Artificial Sequence
  Synthetic
KETAAAKFERQHMDS

SEQ ID NO: 267 - protein, 38 aa, Artificial Sequence
  Synthetic
MDEKTTGWRGGHVVEGLAGELEQLRARLEHHPQGQREP

SEQ ID NO: 268 - protein, 13 aa, Artificial Sequence
  Synthetic
SLAELLNAGLGGS

SEQ ID NO: 269 - protein, 8 aa, Artificial Sequence
  Synthetic
TQDPSRVG

SEQ ID NO: 270 - protein, 12 aa, Artificial Sequence
  Synthetic
PDRVRAVSHWSS

SEQ ID NO: 271 - protein, 8 aa, Artificial Sequence
  Synthetic
WSHPQFEK

SEQ ID NO: 272 - protein, 6 aa, Artificial Sequence
  Synthetic
CCPGCC

SEQ ID NO: 273 - protein, 10 aa, Artificial Sequence
  Synthetic
EVHTNQDPLD

SEQ ID NO: 274 - protein, 14 aa, Artificial Sequence
  Synthetic
GKPIPNPLLGLDST

SEQ ID NO: 275 - protein, 11 aa, Artificial Sequence
  Synthetic
YTDIEMNRLGK

SEQ ID NO: 276 - protein, 8 aa, Artificial Sequence
  Synthetic
DLYDDDDK

SEQ ID NO: 277 - RNA, 65 nt, Artificial Sequence
  Synthetic
accuucuugcauggcucugccaacgcuacggcuuggcgggcuggccuuuccucaauaggugguca

SEQ ID NO: 278 - protein, 6 aa, Artificial Sequence
  Synthetic
DTYRYI

SEQ ID NO: 279 - protein, 6 aa, Artificial Sequence
  Synthetic
TDFYLK

SEQ ID NO: 280 - protein, 11 aa, Artificial Sequence
  Synthetic
MASMTGGQQMG

SEQ ID NO: 281 - protein, 6 aa, Artificial Sequence
  Synthetic
QYPALT

SEQ ID NO: 282 - protein, 10 aa, Artificial Sequence
  Synthetic
SSTSSDFRDR

SEQ ID NO: 283 - protein, 19 aa, Artificial Sequence
  Synthetic
KDHLIHNVHKEFHAHAHNK

SEQ ID NO: 284 - protein, 8 aa, Artificial Sequence
  Synthetic
QPELAPED

SEQ ID NO: 285 - protein, 5 aa, Artificial Sequence
  Synthetic
RRRRR

SEQ ID NO: 286 - protein, 4 aa, Artificial Sequence
  Synthetic
CCCC

SEQ ID NO: 287 - protein, 11 aa, Artificial Sequence
  Synthetic
FFFFFFFFFFF

SEQ ID NO: 288 - protein, 9 aa, Artificial Sequence
  Synthetic
NANNPDWDF

SEQ ID NO: 289 - protein, 15 aa, Artificial Sequence
  Synthetic
KETAAAKFERQHMDS

SEQ ID NO: 290 - protein, 11 aa, Artificial Sequence
  Synthetic
YTDIEMNRLGK

SEQ ID NO: 291 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 292 - DNA, 2365 bp, Homo sapiens
gcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 293 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHNCVNITIKQHTVTTTTKGENFTETDVKMMERVVEQMCITQYERESQAYYQRGSSMVLFSSPPVILLISFLIFLIVG

SEQ ID NO: 294 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHKVTTTTKGENFTETDVKMMERVVEQMCITQYERESQAYYQRGSSMVLFSSPPVILLISFLIFLIVG

SEQ ID NO: 295 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGKNFTETDVKMMERVVEQMCITQYERESQAYYQRGSSMVLFSSPPVILLISFLIFLIVG

SEQ ID NO: 296 - protein, 240 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGANFTETDVKMMERVVEQMCITQYERESQAYYQRGSSMVLFSSPPV

SEQ ID NO: 297 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTKTDVKMMERVVEQMCITQYERESQAYYQRGSSMVLFSSPPVILLISFLIFLIVG

SEQ ID NO: 298 - protein, 240 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTGTDVKMMERVVEQMCITQYERESQAYYQRGSSMVLFSSPPV

SEQ ID NO: 299 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDIKMMERVVEQMCITQYERESQAYYQRGSSMVLFSSPPVILLISFLIFLIVG

SEQ ID NO: 300 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMEHVVEQMCITQYERESQAYYQRGSSMVLFSSPPVILLISFLIFLIVG

SEQ ID NO: 301 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVIEQMCITQYERESQAYYQRGSSMVLFSSPPVILLISFLIFLIVG

SEQ ID NO: 302 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVQQMCITQYERESQAYYQRGSSMVLFSSPPVILLISFLIFLIVG

SEQ ID NO: 303 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSRVLFSSPPVILLISFLIFLIVG

SEQ ID NO: 304 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKLSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 305 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKLKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 306 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAVAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 307 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLVSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 308 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFGHDCVNITIKQHTVTTTTKGENFTETDVKMMERVVEQMCITQYERESQAYYQRGSSMVLFSSPPVILLISFLIFLIVG

SEQ ID NO: 309 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQRTVTTTTKGENFTETDVKMMERVVEQMCITQYERESQAYYQRGSSMVLFSSPPVILLISFLIFLIVG

SEQ ID NO: 310 - skipped

SEQ ID NO: 311 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENSTETDVKMMERVVEQMCITQYERESQAYYQRGSSMVLFSSPPVILLISFLIFLIVG

SEQ ID NO: 312 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETNVKMMERVVEQMCITQYERESQAYYQRGSSMVLFSSPPVILLISFLIFLIVG

SEQ ID NO: 313 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEPMCITQYERESQAYYQRGSSMVLFSSPPVILLISFLIFLIVG

SEQ ID NO: 314 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITRYERESQAYYQRGSSMVLFSSPPVILLISFLIFLIVG

SEQ ID NO: 315 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSTVLFSSPPVILLISFLIFLIVG

SEQ ID NO: 316 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGSYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 317 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGVYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 318 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYVLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 319 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMGEYSNQNNFVHDCVNITIKQHTVTTTTKGENFTETDVKMMERVVEQMCITQYERESQAYYQRGSSMVLFSSPPVILLISFLIFLIVG

SEQ ID NO: 320 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMNEYSNQNNFVHDCVNITIKQHTVTTTTKGENFTETDVKMMERVVEQMCITQYERESQAYYQRGSSMVLFSSPPVILLISFLIFLIVG

SEQ ID NO: 321 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSSQNNFVHDCVNITIKQHTVTTTTKGENFTETDVKMMERVVEQMCITQYERESQAYYQRGSSMVLFSSPPVILLISFLIFLIVG

SEQ ID NO: 322 - protein, 253 aa, Artificial Sequence [sequence omitted]

SEQ ID NO: 323 - protein, 253 aa, Artificial Sequence
  Synthetic
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSSPVILLISFLIFLIVG

SEQ ID NO: 324 - DNA, 119 bp, Homo sapiens
gcagtggtggggggccttgggttttagagctagaaatagcaagttaaaataaggctagtccgttatcaacttgaaaaagtggcaccgagtcggtgcatgtagacgccaaggccccccac

SEQ ID NO: 325 - DNA, 119 bp, Homo sapiens
tgtgtatcacccagtacgaggttttagagctagaaatagcaagttaaaataaggctagtccgttatcaacttgaaaaagtggcaccgagtcggtgcagattctctcttgtactgggtga

SEQ ID NO: 326 - DNA, 119 bp, Bos Taurus
gcagtggtagggggccttgggttttagagctagaaatagcaagttaaaataaggctagtccgttatcaacttgaaaaagtggcaccgagtcggtgcatgtagacaccaaggccccctac

SEQ ID NO: 327 - DNA, 119 bp, Mesocricetus auratus
gccgtggtggggggccttgggttttagagctagaaatagcaagttaaaataaggctagtccgttatcaacttgaaaaagtggcaccgagtcggtgcatgtagacaccaaggccccccac

SEQ ID NO: 328 - DNA, 119 bp, Mus musculus
gcagtagtggggggccttgggttttagagctagaaatagcaagttaaaataaggctagtccgttatcaacttgaaaaagtggcaccgagtcggtgcatgtagacaccaaggccccccac

SEQ ID NO: 329 - DNA, 119 bp, Odocoileus virginianus; identical to SEQ ID NO: 326

SEQ ID NO: 330 - DNA, 119 bp, Unknown
  Mustela putorius furo
gcggttgtggggggcctggggttttagagctagaaatagcaagttaaaataaggctagtccgttatcaacttgaaaaagtggcaccgagtcggtgcatgtagacgcccaggccccccac

SEQ ID NO: 331 - DNA, 122 bp, Artificial Sequence
  Synthetic
aacttgtttattgcagcttataatggttacaaataaagcaatagcatcacaaatttcacaaataaagcatttttttcactgcattctagttgtggtttgtccaaactcatcaatgtatctta

SEQ ID NO: 332 - DNA, 252 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatctaagatacattgatgagtttggacaaaccacaactagaatgcagtgaaaaaaatgctttatttgtgaaatttgtgatgctattgctttatttgtaaccattataagctgcaataaacaagttctatggccctgactggaa

SEQ ID NO: 333 - DNA, 146 bp, Artificial Sequence
  Synthetic
ccatggcccaacttgtttattgcagcttataatggttacaaataaagcaatagcatcacaaatttcacaaataaagcatttttttcactgcattctagttgtggtttgtccaaactcatcaatgtatcttatcatgtctggatctc

SEQ ID NO: 334 - DNA, 276 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgagatccagacatgataagatacattgatgagtttggacaaaccacaactagaatgcagtgaaaaaaatgctttatttgtgaaatttgtgatgctattgctttatttgtaaccattataagctgcaataaacaagttgggccatggctatggccctgactggaa

SEQ ID NO: 335 - DNA, 244 bp, Artificial Sequence
  Synthetic
tgatcataatcaagccatatcacatctgtagaggtttacttgctttaaaaaacctccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgc

SEQ ID NO: 336 - DNA, 374 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggaggttttttaaagcaagtaaacctctacagatgtgatatggcttgattatgatcactatggccctgactggaa

SEQ ID NO: 337 - DNA, 479 bp, Artificial Sequence
  Synthetic
acgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 338 - DNA, 609 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgtctatggccctgactggaa

SEQ ID NO: 339 - DNA, 228 bp, Artificial Sequence
  Synthetic
cgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgg

SEQ ID NO: 340 - DNA, 358 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgctatggccctgactggaa

SEQ ID NO: 341 - DNA, 527 bp, Artificial Sequence
  Synthetic
ttcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 342 - DNA, 657 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgatctccataagagaagagggacagctatgactgggagtagtcaggagaggaggaaaaatctggctagtaaaacatgtaaggaaaattttagggatgttaaagaaaaaaataacacaaaacaaaatataaaaaaaatctaacctcaagtcaaggcttttctatggaataaggaatggacagcagggggctgtttcatatactgatgacctctttatagccaacctttgttcatggcagccagcatatgggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaactatggccctgactggaa

SEQ ID NO: 343 - DNA, 271 bp, Artificial Sequence
  Synthetic
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatag

SEQ ID NO: 344 - DNA, 401 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacacccgtgcgttttattctgtctttttattgccgtcatagcgcgggttccttccggtattgtctccttccgtgtttcagttagcctcccccctatggccctgactggaa

SEQ ID NO: 345 - DNA, 171 bp, Artificial Sequence
  Synthetic
tagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgact

SEQ ID NO: 346 - DNA, 301 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcagtcaaagcaaagacgccgcagggatttgaaccccgtcctggaaaccaggagtgccaaccaccagcatcttttgctttttttttttttaagctagaaaaaggccaaaaagcaaaacctgagaaaacaatacgtgttgttttctcaggaaaagaaaaaccttcatgaccctactatggccctgactggaa

SEQ ID NO: 347 - DNA, 208 bp, Artificial Sequence
  Synthetic
tgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaa

SEQ ID NO: 348 - DNA, 338 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatctttttttttttttttttttatggattaaacattgacctttatttatgttgtaagttgcattacgttatggtattagtttaatttgagctctaggcacgttaaattgtcaaaagtataacatgtttttccaatatacactgggataaaaaccttgccgtctggtcactggaggtgtccggtgcgaacaaggaaaaacccagccaaaacactatggccctgactggaa

SEQ ID NO: 349 - DNA, 636 bp, Artificial Sequence
  Synthetic
tgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaaacacactgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaatctctctgttttggctgggtttttccttgttcgcaccggacacctccagtgaccagacggcaaggtttttatcccagtgtatattggaaaaacatgttatacttttgacaatttaacgtgcctagagctcaaattaaactaataccataacgtaatgcaacttacaacataaataaaggtcaatgtttaatccataaaaaaaaaaaaaaaaaaa

SEQ ID NO: 350 - DNA, 766 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatctttttttttttttttttttatggattaaacattgacctttatttatgttgtaagttgcattacgttatggtattagtttaatttgagctctaggcacgttaaattgtcaaaagtataacatgtttttccaatatacactgggataaaaaccttgccgtctggtcactggaggtgtccggtgcgaacaaggaaaaacccagccaaaacagagagatttttttttttttttttttatggattaaacattgacctttatttatgttgtaagttgcattacgttatggtattagtttaatttgagctctaggcacgttaaattgtcaaaagtataacatgtttttccaatatacactgggataaaaaccttgccgtctggtcactggaggtgtccggtgcgaacaaggaaaaacccagccaaaacagtgtgttttttttttttttttttttatggattaaacattgacctttatttatgttgtaagttgcattacgttatggtattagtttaatttgagctctaggcacgttaaattgtcaaaagtataacatgtttttccaatatacactgggataaaaaccttgccgtctggtcactggaggtgtccggtgcgaacaaggaaaaacccagccaaaacactatggccctgactggaa

SEQ ID NO: 351 - DNA, 204 bp, Artificial Sequence
  Synthetic
cagcaagttcagagaaatctgaacttgctggatttttggagcagggagatggaataggagcttgctccgtccactccacgcatcgacctggtattgcagtacctccaggaacggtgcacccactttctggagtttcaaaagtagactgtacgctaagggtcatatctttttttgtttggtttgtgtcttggttggcgtcttaaa

SEQ ID NO: 352 - DNA, 334 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatctttaagacgccaaccaagacacaaaccaaacaaaaaaagatatgacccttagcgtacagtctacttttgaaactccagaaagtgggtgcaccgttcctggaggtactgcaataccaggtcgatgcgtggagtggacggagcaagctcctattccatctccctgctccaaaaatccagcaagttcagatttctctgaacttgctgctatggccctgactggaa

SEQ ID NO: 353 - DNA, 73 bp, Artificial Sequence
  Synthetic
gtttcaaaagtagactgtacgctaagggtcatatctttttttgtttggtttgtgtcttggttggcgtcttaaa

SEQ ID NO: 354 - DNA, 203 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatctttaagacgccaaccaagacacaaaccaaacaaaaaaagatatgacccttagcgtacagtctacttttgaaacctatggccctgactggaa

SEQ ID NO: 355 - DNA, 73 bp, Artificial Sequence
  Synthetic
gcccggctagctcagtcggtagagcatgagactcttaatctcagggtcgtgggttcgagccccacgttgggcg

SEQ ID NO: 356 - DNA, 203 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatccgcccaacgtggggctcgaacccacgaccctgagattaagagtctcatgctctaccgactgagctagccgggcctatggccctgactggaa

SEQ ID NO: 357 - DNA, 49 bp, Artificial Sequence
  Synthetic
gagacggtcgggtccagatattcgtatctgtcgagtagagtgtgggctc

SEQ ID NO: 358 - DNA, 179 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgagcccacactctactcgacagatacgaatatctggacccgaccgtctcctatggccctgactggaa

SEQ ID NO: 359 - DNA, 98 bp, Artificial Sequence
  Synthetic
gacgcaactgaatgaaatggtgaaggacgggtccaggtgtggctgcttcggcagtgcagcttgttgagtagagtgtgagctccgtaactagtcgcgtc

SEQ ID NO: 360 - DNA, 228 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgacgcgactagttacggagctcacactctactcaacaagctgcactgccgaagcagccacacctggacccgtccttcaccatttcattcagttgcgtcctatggccctgactggaa

SEQ ID NO: 361 - DNA, 95 bp, Artificial Sequence
  Synthetic
gatgtaactgaatgaaatggtgaaggacgggtccagtaggctgcttcggcagcctacttgttgagtagagtgtgagctccgtaactagttacatc

SEQ ID NO: 362 - DNA, 225 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgatgtaactagttacggagctcacactctactcaacaagtaggctgccgaagcagcctactggacccgtccttcaccatttcattcagttacatcctatggccctgactggaa

SEQ ID NO: 363 - DNA, 40 bp, Artificial Sequence
  Synthetic
ggcacgtacgaagggacggtgcggagaggagagtacgtgc

SEQ ID NO: 364 - DNA, 170 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgcacgtactctcctctccgcaccgtcccttcgtacgtgccctatggccctgactggaa

SEQ ID NO: 365 - DNA, 68 bp, Artificial Sequence
  Synthetic
ggccggcatggtcccagcctcctcgctggcgccggctgggcaacatgcttcggcatggcgaatgggac

SEQ ID NO: 366 - DNA, 198 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcgtcccattcgccatgccgaagcatgttgcccagccggcgccagcgaggaggctgggaccatgccggccctatggccctgactggaa

SEQ ID NO: 367 - DNA, 25 bp, Artificial Sequence
  Synthetic
ggactctaggactggactttggact

SEQ ID NO: 368 - DNA, 155 bp, Artificial Sequence
  Synthetic
atccttccagtcagggccatgtttgagagctagaaatagcaagtttaaataaggctagtccgttatcaacttgaaaaagtgggaccgagtcggtccacctgaaccgtatatcagtccaaagtccagtcctagagtccctatggccctgactggaa

SEQ ID NO: 369 - DNA, 1719 bp, Artificial Sequence
  Synthetic
gttcgttgcaacaaattgatgagcaatgcttttttataatgccaactttgtacaaaaaagttggcatgacaagttccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctaccctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctgcccaactttcttgtacaaagttggcattataagaaagcattgcttatcaatttgttgcaacgaac

SEQ ID NO: 370 - protein, 529 aa, Artificial Sequence
  Synthetic
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYPGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 371 - DNA, 25 bp, Artificial Sequence
  Synthetic
  misc_feature (1)..(5): n is a, c, g, or t
nnnnntcatcctgataaactgcaaa

SEQ ID NO: 372 - DNA, 82 bp, Artificial Sequence
  Synthetic
  misc_feature (1)..(5): n is a, c, g, or t
nnnnncagtttgtacggatgactgatgagtcccaaataggacgaaacgcgcttcggtgcgtctcatcctgataaactgcaaa

SEQ ID NO: 373 - DNA, 333 bp, Artificial Sequence
  Synthetic
acctgaaccgtatatcgacgcaccgaagcgcgtttcgtcctatttgggactcatcaggatatacggttcaggtgatatacggttcaggtgacgcaccgaagcgcgtttcgtcctatttgggactcatcagacctgaaccgtatatcatccttccagtcagggccatgtttgagagctagaaatagcaagtttaaataaggctagtccgttatcaacttgaaaaagtgggaccgagtcggtccacctgaaccgtatatcgacgcaccgaagcgcgtttcgtcctatttgggactcatcaggatatacggttcaggtctatggccctgactggaa

SEQ ID NO: 374 - DNA, 34 bp, Artificial Sequence
  Synthetic
cctgggtcaatccttggggcccagactgagcacg

SEQ ID NO: 375 - DNA, 51 bp, Artificial Sequence
  Synthetic
cctgggtcaatccttggggcccagactgagcacgtgatggcagaggaaagg

SEQ ID NO: 376 - DNA, 51 bp, Artificial Sequence
  Synthetic
cctttcctctgccatcacgtgctcagtctgggccccaaggattgacccagg

SEQ ID NO: 377 - DNA, 17 bp, Artificial Sequence
  Synthetic
tgatggcagaggaaagg

SEQ ID NO: 378 - DNA, 23 bp, Artificial Sequence
  Synthetic
gcaggctttaaaggaaccaattc

SEQ ID NO: 379 - DNA, 43 bp, Artificial Sequence
  Synthetic
gcaggctttaaaggaaccaattccctgggtcaatccttggggc

SEQ ID NO: 380 - DNA, 20 bp, Artificial Sequence
  Synthetic
ctctggaggatctagcggag

SEQ ID NO: 381 - DNA, 40 bp, Artificial Sequence
  Synthetic
ctctggaggatctagcggagtttttttttttttttttttt

SEQ ID NO: 382 - DNA, 34 bp, Artificial Sequence
  Synthetic
ctctggaggatctagcggagcccccccccccccc

SEQ ID NO: 383 - DNA, 20 bp, Artificial Sequence
  Synthetic
ggcccagactgagcacgtga

SEQ ID NO: 384 - DNA, 20 bp, Artificial Sequence
  Synthetic
ggcccagactgagcacgtga

SEQ ID NO: 385 - DNA, 20 bp, Artificial Sequence
  Synthetic
ggcccagactgagcacgtga

SEQ ID NO: 386 - DNA, 20 bp, Artificial Sequence
  Synthetic
ggcccagactgagcacgtga

SEQ ID NO: 387 - DNA, 20 bp, Artificial Sequence
  Synthetic
ggcccagactgagcacgtga

SEQ ID NO: 388 - DNA, 20 bp, Artificial Sequence
  Synthetic
ggcccagactgagcacgtga

SEQ ID NO: 389 - DNA, 20 bp, Artificial Sequence
  Synthetic
ggcccagactgagcacgtga

SEQ ID NO: 390 - DNA, 20 bp, Artificial Sequence
  Synthetic
ggcccagactgagcacgtga

SEQ ID NO: 391 - DNA, 20 bp, Artificial Sequence
  Synthetic
ggcccagactgagcacgtga

SEQ ID NO: 392 - DNA, 20 bp, Artificial Sequence
  Synthetic
ggcccagactgagcacgtga

SEQ ID NO: 393 - DNA, 20 bp, Artificial Sequence
  Synthetic
ggcccagactgagcacgtga

SEQ ID NO: 394 - DNA, 23 bp, Artificial Sequence
  Synthetic
tctgctatcacgtgctcagtctg

SEQ ID NO: 395 - DNA, 20 bp, Artificial Sequence
  Synthetic
gcacatactagcccctgtct

SEQ ID NO: 396 - protein, 15 aa, Artificial Sequence
  Synthetic
QYIKANSKFIGITEL

SEQ ID NO: 397 - DNA, 45 bp, Artificial Sequence
  Synthetic
catgatataaaagcaaattctaaatttataggtataactgaacta

SEQ ID NO: 398 - protein, 535 aa, Artificial Sequence
  Synthetic
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 399 - DNA, 1605 bp, Artificial Sequence
  Synthetic
ggcgccgacgacgtggtggacagcagcaagagcttcgtgatggagaacttcagcagctaccacggcaccaagcccggctacgtggacagcatccagaagggcatccagaagcccaagagcggcacccagggcaactacgacgacgactggaaggagttctacagcaccgacaacaagtacgacgccgccggctacagcgtggacaacgagaaccccctgagcggcaaggccggcggcgtggtgaaggtgacctaccccggcctgaccaaggtgctggccctgaaggtggacaacgccgagaccatcaagaaggagctgggcctgagcctgaccgagcccctgatggagcaggtgggcaccgaggagttcatcaagaggttcggcgacggcgccagcagggtggtgctgagcctgcccttcgccgagggcagcagcagcgtggagtacatcaacaactgggagcaggccaaggccctgagcgtggagctggagatcaacttcgagaccaggggcaagaggggccaggacgccatgtacgagtacatggcccaggcctgcgccggcaacagggtgaggaggagcgtgggcagcagcctgagctgcatcaacctggactgggacgtgatcagggacaagaccaagaccaagatcgagagcctgaaggagcacggccccatcaagaacaagatgagcgagagccccaacaagaccgtgagcgaggagaaggccaagcagtacctggaggagttccaccagaccgccctggagcaccccgagctgagcgagctgaagaccgtgaccggcaccaaccccgtgttcgccggcgccaactacgccgcctgggccgtgaacgtggcccaggtgatcgacagcgagaccgccgacaacctggagaagaccaccgccgccctgagcatcctgcccggcatcggcagcgtgatgggcatcgccgacggcgccgtgcaccacaacaccgaggagatcgtggcccagagcatcgccctgagcagcctgatggtggcccaggccatccccctggtgggcgagctggtggacatcggcttcgccgcctacaacttcgtggagagcatcatcaacctgttccaggtggtgcacaacagctacaacaggcccgcctacagccccggccacaagacccagcccttcctgcacgacggctacgccgtgagctggaacaccgtggaggacagcatcatcaggaccggcttccagggcgagagcggccacgacatcaagatcaccgccgagaacacccccctgcccatcgccggcgtgctgctgcccaccatccccggcaagctggacgtgaacaagagcaagacccacatcagcgtgaacggcaggaagatcaggatgaggtgcagggccatcgacggcgacgtgaccttctgcaggcccaagagccccgtgtacgtgggcaacggcgtgcacgccaacctgcacgtggccttccacaggagcagcagcgagaagatccacagcaacgagatcagcagcgacagcatcggcgtgctgggctaccagaagaccgtggaccacaccaaggtgaacagcaagctgagcctgttcttcgagatcaagagc

SEQ ID NO: 400 - protein, 15 aa, Artificial Sequence
  Synthetic
GTYRLIPNARANLTA

SEQ ID NO: 401 - DNA, 45 bp, Artificial Sequence
  Synthetic
ggcacctacaggctgatccccaacgccagggccaacctgaccgcc

SEQ ID NO: 402 - protein, 21 aa, Artificial Sequence
  Synthetic
PSKFFTISDSATFAPGPVSNA

SEQ ID NO: 403 - DNA, 63 bp, Artificial Sequence
  Synthetic
ccgagcaaattttttaccattagcgatagcgcgacctttgcgccgggcccggtgagcaacgcg

SEQ ID NO: 404 - protein, 21 aa, Artificial Sequence
  Synthetic
PSKLFIMLDNATFAPGPVVNA

SEQ ID NO: 405 - DNA, 63 bp, Artificial Sequence
  Synthetic
ccgagcaaactgtttattatgctggataacgcgacctttgcgccgggcccggtggtgaacgcg

SEQ ID NO: 406 - protein, 27 aa, Artificial Sequence
  Synthetic
TPPPYQVSCGGESDRASARVIDPAAQS

SEQ ID NO: 407 - DNA, 81 bp, Artificial Sequence
  Synthetic
accccccccccctaccaggtgagctgcggcggcgagagcgacagggccagcgccagggtgatcgaccccgccgcccagagc

SEQ ID NO: 408 - protein, 134 aa, Artificial Sequence
  Synthetic
PEYAYKIVKNKKMEDGFLQGMVDGWYGHHSNEQGSGLMENERTLDKANPNNDLCSWSDHEASSNNTNQEDLLQRESRRKKRIGTSTLNQRGNCNTKCQTEEARLKREEVSLVKSDQCSNGSLQCRANNSTEQVD

SEQ ID NO: 409 - DNA, 402 bp, Artificial Sequence
  Synthetic
cccgagtacgcctacaagatcgtgaagaacaagaagatggaggacggcttcctgcagggcatggtggacggctggtacggccaccacagcaacgagcagggcagcggcctgatggagaacgagaggaccctggacaaggccaaccccaacaacgacctgtgcagctggagcgaccacgaggccagcagcaacaacaccaaccaggaggacctgctgcagagggagagcaggaggaagaagaggatcggcaccagcaccctgaaccagaggggcaactgcaacaccaagtgccagaccgaggaggccaggctgaagagggaggaggtgagcctggtgaagagcgaccagtgcagcaacggcagcctgcagtgcagggccaacaacagcaccgagcaggtggac

SEQ ID NO: 410 - protein, 154 aa, Artificial Sequence
  Synthetic
TKSTNSRSGGISGPDNEAPVGEAPSPYGDNPRPNDGNNIRIGSKGYNGIITDTIEESCSCYPDAKVVKSVELDSTIWTSGSSPNQKIITIGWDPNGWTGTPMSPNGAYGTDGPSNGQANQHQAESISAGNSSLCPIRDNWHGSNRSWSWPDGAE

SEQ ID NO: 411 - DNA, 462 bp, Artificial Sequence
  Synthetic
accaagagcaccaacagcaggagcggcggcatcagcggccccgacaacgaggcccccgtgggcgaggcccccagcccctacggcgacaaccccaggcccaacgacggcaacaacatcaggatcggcagcaagggctacaacggcatcatcaccgacaccatcgaggagagctgcagctgctaccccgacgccaaggtggtgaagagcgtggagctggacagcaccatctggaccagcggcagcagccccaaccagaagatcatcaccatcggctgggaccccaacggctggaccggcacccccatgagccccaacggcgcctacggcaccgacggccccagcaacggccaggccaaccagcaccaggccgagagcatcagcgccggcaacagcagcctgtgccccatcagggacaactggcacggcagcaacaggagctggagctggcccgacggcgccgag

SEQ ID NO: 412 - protein, 45 aa, Artificial Sequence
  Synthetic
EKIVLLLAMMEKIVLLLAKCQTPMGAIKAVDGVTNKCPYLGSPSF

SEQ ID NO: 413 - DNA, 135 bp, Artificial Sequence
  Synthetic
gagaagatcgtgctgctgctggccatgatggagaagatcgtgctgctgctggccaagtgccagacccccatgggcgccatcaaggccgtggacggcgtgaccaacaagtgcccctacctgggcagccccagcttc

SEQ ID NO: 414 - protein, 36 aa, Artificial Sequence
  Synthetic
IRPCFWVELNPNQKIITIRPCFWVELICYPDAGEIT

SEQ ID NO: 415 - DNA, 108 bp, Artificial Sequence
  Synthetic
atcaggccctgcttctgggtggagctgaaccccaaccagaagatcatcaccatcaggccctgcttctgggtggagctgatctgctaccccgacgccggcgagatcacc

SEQ ID NO: 416 - protein, 45 aa, Artificial Sequence
  Synthetic
MEKIVLLLAEKIVLLLAMCPYLGSPSFKCQTPMGAIKAVDGVTNK

SEQ ID NO: 417 - DNA, 135 bp, Artificial Sequence
  Synthetic
atggagaagatcgtgctgctgctggccgagaagatcgtgctgctgctggccatgtgcccctacctgggcagccccagcttcaagtgccagacccccatgggcgccatcaaggccgtggacggcgtgaccaacaag

SEQ ID NO: 418 - protein, 36 aa, Artificial Sequence
  Synthetic
NPNQKIITICYPDAGEITIRPCFWVELRPCFWVELI

SEQ ID NO: 419 - DNA, 108 bp, Artificial Sequence
  Synthetic
aaccccaaccagaagatcatcaccatctgctaccccgacgccggcgagatcaccatcaggccctgcttctgggtggagctgaggccctgcttctgggtggagctgatc

SEQ ID NO: 420 - protein, 18 aa, Artificial Sequence
  Synthetic
MVSLVKSDQIGTSTLNQR

SEQ ID NO: 421 - DNA, 54 bp, Artificial Sequence
  Synthetic
atggtgagcctggtgaagagcgaccagatcggcaccagcaccctgaaccagagg

SEQ ID NO: 422 - protein, 9 aa, Artificial Sequence
  Synthetic
YNGIITDTI

SEQ ID NO: 423 - DNA, 27 bp, Artificial Sequence
  Synthetic
tacaacggcatcatcaccgacaccatc

SEQ ID NO: 424 - protein, 63 aa, Artificial Sequence
  Synthetic
MEKIVLLLAEKIVLLLAMMVSLVKSDQCPYLGSPSFIGTSTLNQRKCQTPMGAIKAVDGVTNK

SEQ ID NO: 425 - DNA, 135 bp, Artificial Sequence
  Synthetic
atggagaagatcgtgctgctgctggccgagaagatcgtgctgctgctggccatgatggtgagcctggtgaagagcgaccagtgcccctacctgggcagccccagcttcatcggcaccagcaccctgaaccagagg

SEQ ID NO: 426 - protein, 45 aa, Artificial Sequence
  Synthetic
NPNQKIITIYNGIITDTICYPDAGEITIRPCFWVELRPCFWVELI

SEQ ID NO: 427 - DNA, 135 bp, Artificial Sequence
  Synthetic
aaccccaaccagaagatcatcaccatctacaacggcatcatcaccgacaccatctgctaccccgacgccggcgagatcaccatcaggccctgcttctgggtggagctgaggccctgcttctgggtggagctgatc

SEQ ID NO: 428 - protein, 535 aa, Artificial Sequence; identical to SEQ ID NO: 398
  Synthetic

SEQ ID NO: 429 - DNA, 27 bp, Artificial Sequence
  Synthetic
ggctaaccgtgccatttgatcaggtca

SEQ ID NO: 430 - DNA, 27 bp, Artificial Sequence
  Synthetic
ggctaaccgtgcaaattaacaaactaa

SEQ ID NO: 431 - DNA, 28 bp, Artificial Sequence
  Synthetic
ggccatctcgtgcaaattaacaaactaa

SEQ ID NO: 432 - DNA, 35 bp, Artificial Sequence
  Synthetic
ggtcctctgccatctcgtgcaaattaacaaactaa

SEQ ID NO: 433 - DNA, 42 bp, Artificial Sequence
  Synthetic
ggcttcctttcctctgccatctcgtgcaaattaacaaactaa

SEQ ID NO: 434 - DNA, 27 bp, Artificial Sequence
  Synthetic
ggctaaccgtgccatttgatcaggtca

SEQ ID NO: 435 - DNA, 27 bp, Artificial Sequence
  Synthetic
ggctaaccgtgcaaattaacaaactaa

SEQ ID NO: 436 - DNA, 28 bp, Artificial Sequence
  Synthetic
ggccatctcgtgcaaattaacaaactaa

SEQ ID NO: 437 - DNA, 35 bp, Artificial Sequence; identical to SEQ ID NO: 432
  Synthetic

SEQ ID NO: 438 - DNA, 42 bp, Artificial Sequence; identical to SEQ ID NO: 433
  Synthetic

SEQ ID NO: 439 - DNA, 17 bp, Artificial Sequence
  Synthetic
tctgccatctcgtgctc

SEQ ID NO: 440 - DNA, 17 bp, Artificial Sequence
  Synthetic
tctgccatctcgtgctc

SEQ ID NO: 441 - DNA, 18 bp, Artificial Sequence
  Synthetic
tctgccatcatcgtgctc

SEQ ID NO: 442 - DNA, 16 bp, Artificial Sequence
  Synthetic
tctgccatccgtgctc

SEQ ID NO: 443 - protein, 1517 aa, Streptococcus pyogenes
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNSGGSKRTADGSEFEPKKKRKV

SEQ ID NO: 444 - skipped

SEQ ID NO: 445 - protein, 1367 aa, Streptococcus pyogenes; identical to SEQ ID NO: 55

SEQ ID NO: 446 - protein, 8 aa, Artificial Sequence
  Synthetic
SGGSSGGS

SEQ ID NO: 447 - protein, 106 aa, Artificial Sequence
  Synthetic
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNSGGS

SEQ ID NO: 448-449 - skipped (2 entries)

SEQ ID NO: 450 - protein, 780 aa, Staphylococcus pyogenes
MKRTADGSEFESPKKKRKVIKIATRKYLGKQNVYDIGVERDHNFALKNGFIASNCFNSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 451 - skipped

SEQ ID NO: 452 - protein, 35 aa, Artificial Sequence
  Synthetic
IKIATRKYLGKQNVYDIGVERDHNFALKNGFIASN

SEQ ID NO: 453 - protein, 28 aa, Artificial Sequence
  Synthetic
CFNSGSETPGTSESATPESSGGSSGGSS

SEQ ID NO: 454 - protein, 677 aa, Unknown; identical to SEQ ID NO: 89
  moloney murine leukemia virus

SEQ ID NO: 455 - DNA, 21 bp, Artificial Sequence
  Synthetic
gtgccatcacgtgctcagtct

SEQ ID NO: 456 - DNA, 21 bp, Artificial Sequence
  Synthetic
gagcgatccaggtgctgcaga

SEQ ID NO: 457 - DNA, 20 bp, Artificial Sequence
  Synthetic
ggagcccttcttcttctgct

SEQ ID NO: 458 - protein, 881 aa, Staphylococcus aureus
MKRTADGSEFESPKKKRKVGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAECLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNSGGSKRTADGSEFEPKKKRKV

SEQ ID NO: 459 - skipped

SEQ ID NO: 460 - protein, 739 aa, Artificial Sequence
  Synthetic
GKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAE

SEQ ID NO: 461 - skipped

SEQ ID NO: 462 - protein, 102 aa, Artificial Sequence
  Synthetic
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 463-464 - skipped (2 entries)

SEQ ID NO: 465 - protein, 1099 aa, Staphylococcus aureus
MKRTADGSEFESPKKKRKVIKIATRKYLGKQNVYDIGVERDHNFALKNGFIASNCFNEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 466 - skipped

SEQ ID NO: 467 - protein, 314 aa, Artificial Sequence
  Synthetic
CFNEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 468-470 - skipped (3 entries)

SEQ ID NO: 471 - protein, 677 aa, Unknown; identical to SEQ ID NO: 89
  moloney murine leukemia virus

SEQ ID NO: 472 - protein, 413 aa, Artificial Sequence; identical to SEQ ID NO: 8
  Synthetic

SEQ ID NO: 473 - protein, 413 aa, Artificial Sequence; identical to SEQ ID NO: 9
  Synthetic

SEQ ID NO: 474 - protein, 413 aa, Artificial Sequence; identical to SEQ ID NO: 10
  Synthetic

SEQ ID NO: 475 - protein, 413 aa, Artificial Sequence; identical to SEQ ID NO: 11
  Synthetic

SEQ ID NO: 476 - protein, 413 aa, Artificial Sequence; identical to SEQ ID NO: 12
  Synthetic

SEQ ID NO: 477 - protein, 413 aa, Artificial Sequence; identical to SEQ ID NO: 13
  Synthetic

SEQ ID NO: 478 - protein, 413 aa, Artificial Sequence; identical to SEQ ID NO: 14
  Synthetic

SEQ ID NO: 479 - protein, 413 aa, Artificial Sequence; identical to SEQ ID NO: 15
  Synthetic

SEQ ID NO: 480-481 - skipped (2 entries)

SEQ ID NO: 482 - protein, 1368 aa, Streptococcus pyogenes [sequence omitted]

SEQ ID NO: 483 - DNA, 4104 bp, Streptococcus pyogenes; identical to SEQ ID NO: 19

SEQ ID NO: 484 - DNA, 4104 bp, Streptococcus pyogenes; identical to SEQ ID NO: 20

SEQ ID NO: 485 - protein, 1367 aa, Streptococcus pyogenes; identical to SEQ ID NO: 21

SEQ ID NO: 486 - DNA, 4212 bp, Streptococcus pyogenes; identical to SEQ ID NO: 22

SEQ ID NO: 487 - protein, 240 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPV

SEQ ID NO: 488 - protein, 108 aa, Artificial Sequence
  Synthetic
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 489 - protein, 108 aa, Artificial Sequence
  Synthetic
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 490 - protein, 165 aa, Artificial Sequence
  Synthetic
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 491 - protein, 108 aa, Artificial Sequence; identical to SEQ ID NO: 488
  Synthetic

SEQ ID NO: 492 - skipped

SEQ ID NO: 493 - protein, 216 aa, Homo sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 494 - protein, 212 aa, Mus musculus
MSPGPRLLLPAVLCLGLGALVSSSGSSGVRKRGPSVTDKVFFDVRIGDKDVGRIVIGLFGNVVPKTVENFVALATGEKGYGYKGSIFHRVIKDFMIQGGDFTARDGTGGMSIYGETFPDENFKLKHYGIGWVSMANAGPDTNGSQFFITLTKPTWLDGKHVVFGKVLDGMTVVHSIELQATDGHDRPLTDCTIVNSGKIDVKTPFVVEVPDW

SEQ ID NO: 495 - protein, 108 aa, Artificial Sequence; identical to SEQ ID NO: 489
  Synthetic

SEQ ID NO: 496 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 497 - protein, 159 aa, Escherichia coli [sequence omitted]

SEQ ID NO: 498 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 499 - RNA, 452 nt, Artificial Sequence
  Synthetic
cacgguaggcacuguuaggaguuuuagagcuagaaauagcaaguuaaaauaaggcuaguccguuaucaacuugaaaaaguggcaccgagucggugcuugccucgguccaauccuuccggagugcagguggaaaccaucuccccaggagacgggcgcaccuuccccaagcgcggccagaccugcguggugcacuacaccgggaugcuugaagauggaaagaaauuugauuccucccgggacagaaacaagcccuuuaaguuuaugcuaggcaagcaggaggugauccgaggcugggaagaagggguugcccagaugagugugggucagagagccaaacugacuauaucuccagauuaugccuauggugccacugggcacccaggcaucaucccaccacaugccacucucgucuucgauguggagcuucuaaaacuggaauaacagugccuacc

SEQ ID NO: 500 - DNA, 464 bp, Artificial Sequence
  Synthetic
ggcccagactgagcacgtgagttttagagctagaaatagcaagttaaaataaggctagtccgttatcaacttgaaaaagtggcaccgagtcggtgctggaggaagcagggcttcctttcctctgccatcattccagttttagaagctccacatcgaagacgagagtggcatgtggtgggatgatgcctgggtgcccagtggcaccataggcataatctggagatatagtcagtttggctctctgacccacactcatctgggcaaccccttcttcccagcctcggatcacctcctgcttgcctagcataaacttaaagggcttgtttctgtcccgggaggaatcaaatttctttccatcttcaagcatcccggtgtagtgcaccacgcaggtctggccgcgcttggggaaggtgcgcccgtctcctggggagatggtttccacctgcactcccgtgctcagtctg

SEQ ID NO: 501 - DNA, 905 bp, Artificial Sequence; identical to SEQ ID NO: 223
  Synthetic

SEQ ID NO: 502 - DNA, 942 bp, Artificial Sequence; identical to SEQ ID NO: 224
  Synthetic

SEQ ID NO: 503 - DNA, 1370 bp, Artificial Sequence; identical to SEQ ID NO: 225
  Synthetic

SEQ ID NO: 504 - DNA, 807 bp, Artificial Sequence; identical to SEQ ID NO: 226
  Synthetic

SEQ ID NO: 505 - DNA, 743 bp, Artificial Sequence; identical to SEQ ID NO: 227
  Synthetic

SEQ ID NO: 506 - DNA, 20 bp, Artificial Sequence
  Synthetic
ggcccagactgagcacgtga

SEQ ID NO: 507 - DNA, 20 bp, Artificial Sequence
  Synthetic
ggcccagactgagcacgtga

SEQ ID NO: 508 - DNA, 20 bp, Artificial Sequence
  Synthetic
ggcccagactgagcacgtga

SEQ ID NO: 509 - DNA, 20 bp, Artificial Sequence
  Synthetic
ggcccagactgagcacgtga

SEQ ID NO: 510 - DNA, 20 bp, Artificial Sequence
  Synthetic
ggcccagactgagcacgtga

SEQ ID NO: 511 - DNA, 20 bp, Artificial Sequence
  Synthetic
ggcactgcggctggaggtgg

SEQ ID NO: 512 - DNA, 20 bp, Artificial Sequence
  Synthetic
gagtccgagcagaagaagaa

SEQ ID NO: 513 - DNA, 20 bp, Artificial Sequence
  Synthetic
ggaatcccttctgcagcacc

SEQ ID NO: 514 - protein, 1803 aa, Artificial Sequence; identical to SEQ ID NO: 162
  Synthetic

SEQ ID NO: 515 - protein, 2117 aa, Artificial Sequence; identical to SEQ ID NO: 163
  Synthetic

SEQ ID NO: 516 - protein, 2117 aa, Artificial Sequence; identical to SEQ ID NO: 164
  Synthetic

SEQ ID NO: 517 - DNA, 34 bp, Artificial Sequence
  Synthetic
ataacttcgtatagcatacattatacgaagttat

SEQ ID NO: 518 - DNA, 32 bp, Artificial Sequence
  Synthetic
taactttaaataatgccaattatttaaagtta

SEQ ID NO: 519 - DNA, 34 bp, Artificial Sequence
  Synthetic
tcaatttctgagaactgtcattctcggaaattga

SEQ ID NO: 520 - DNA, 34 bp, Artificial Sequence
  Synthetic
ctcgtgtccgataactgtaattatcggacatgat

SEQ ID NO: 521 - DNA, 34 bp, Artificial Sequence
  Synthetic
gaagttcctattctctagaaagtataggaacttc

SEQ ID NO: 522 - DNA, 39 bp, Artificial Sequence
  Synthetic
gagtttcattaaggaataactaattccctaatgaaactc

SEQ ID NO: 523 - DNA, 33 bp, Artificial Sequence
  Synthetic
ggttgcttaagaataagtaattcttaagcaacc

SEQ ID NO: 524 - DNA, 43 bp, Artificial Sequence
  Synthetic
acgaaaaatggtaaggaatagaccattccttaccatttttggt

SEQ ID NO: 525 - DNA, 31 bp, Artificial Sequence
  Synthetic
ttgatgaaagaataacgtattctttcatcaa

SEQ ID NO: 526 - DNA, 33 bp, Artificial Sequence
  Synthetic
gtgcgtcaaataataacgtattatttgacactt

SEQ ID NO: 527 - DNA, 34 bp, Artificial Sequence
  Synthetic
aataggtctgagaacgcccattctcagacgtatt

SEQ ID NO: 528 - DNA, 34 bp, Artificial Sequence
  Synthetic
tgaatgtcctataattacacttataggacattca

SEQ ID NO: 529 - DNA, 34 bp, Artificial Sequence
  Synthetic
gaaactttaaataataagtcttatttaaagtttc

SEQ ID NO: 530 - DNA, 61 bp, Artificial Sequence
  Synthetic
aaacgatatcagacatttgtctgataatgcttcattatcagacaaatgtctgatatcgttt

SEQ ID NO: 531 - DNA, 34 bp, Artificial Sequence
  Synthetic
atatatacgtatatagacatatatacgtatatat

SEQ ID NO: 532 - DNA, 34 bp, Artificial Sequence
  Synthetic
ataactctatataatgtatgctatatagagttat

SEQ ID NO: 533 - DNA, 34 bp, Artificial Sequence
  Synthetic
acaacatcctattacaccctatatgccaacatgg

SEQ ID NO: 534 - DNA, 34 bp, Artificial Sequence
  Synthetic
aacccactgcttaagcctcaataaagcttgcctt

SEQ ID NO: 535 - DNA, 34 bp, Artificial Sequence
  Synthetic
gatacaacgtatatacctttctatacgttgttta

SEQ ID NO: 536 - DNA, 48 bp, Artificial Sequence
  Synthetic
ggtttgtctggtcaaccaccgcggtctcagtggtgtacggtacaaacc

SEQ ID NO: 537 - DNA, 38 bp, Artificial Sequence
  Synthetic
ggcttgtcgacgacggcggtctccgtcgtcaggatcat

SEQ ID NO: 538 - DNA, 42 bp, Artificial Sequence
  Synthetic
gtgccccaactggggtaacctttgagttctctcagttggggg

SEQ ID NO: 539 - DNA, 45 bp, Artificial Sequence
  Synthetic
tgcgggtgccagggcgtgcccttgggctccccgggcgcgtactcc

SEQ ID NO: 540 - DNA, 50 bp, Artificial Sequence
  Synthetic
tgttccccaaagcgataccacttgaagcagtggtactgcttgtgggtaca

SEQ ID NO: 541 - DNA, 64 bp, Artificial Sequence
  Synthetic
gcatgttccccaaagcgataccacttgaagcagtggtactgcttgtgggtacactctgcgggtg

SEQ ID NO: 542 - DNA, 52 bp, Artificial Sequence
  Synthetic
ggtgctgggttgttgtctctggacagtgatccatgggaaactactcagcacc

SEQ ID NO: 543 - DNA, 34 bp, Artificial Sequence
  Synthetic
caggtttttgacgaaagtgatccagatgatccag

SEQ ID NO: 544 - DNA, 54 bp, Artificial Sequence
  Synthetic
attttaggtatatgattttgtttattagtgtaaataacactatgtacctaaaat

SEQ ID NO: 545 - DNA, 42 bp, Artificial Sequence
  Synthetic
caaaggatcactgaatcaaaagtattgctcatccacgcgaaa

SEQ ID NO: 546 - DNA, 55 bp, Artificial Sequence
  Synthetic
tttgtgcggaactacgaacagttcattaatacgaagtgtacaaacttccatacaa

SEQ ID NO: 547 - DNA, 56 bp, Artificial Sequence
  Synthetic
cgaaaatgtatggaggcacttgtatcaatataggatgtataccttcgaagacactt

SEQ ID NO: 548 - DNA, 53 bp, Artificial Sequence
  Synthetic
gagtttttatttcgtttatttcaattaaggtaactaaaaaactccttttaagg

SEQ ID NO: 549 - DNA, 53 bp, Artificial Sequence
  Synthetic
atgccaacacaattaacatctcaatcaaggtaaatgctttttgctttttttgc

SEQ ID NO: 550 - DNA, 40 bp, Artificial Sequence
  Synthetic
ttcctcgttttctctcgttggaagaagaagaaacgagaaa

SEQ ID NO: 551 - DNA, 40 bp, Artificial Sequence
  Synthetic
tttcggatcaagctatgaaggacgcaaagagggaactaaa

SEQ ID NO: 552 - DNA, 40 bp, Artificial Sequence
  Synthetic
ttcctcgttttctctcgttggacggaaacgaatcgagaaa

SEQ ID NO: 553 - DNA, 40 bp, Artificial Sequence; identical to SEQ ID NO: 551
  Synthetic

SEQ ID NO: 554 - DNA, 52 bp, Artificial Sequence
  Synthetic
gtagtgtatctcacaggtccacggttggccgtggactgctgaagaacattcc

SEQ ID NO: 555 - DNA, 40 bp, Artificial Sequence
  Synthetic
gaaggtgttggtgcggggttggccgtggtcgaggtggggt

SEQ ID NO: 556 - DNA, 52 bp, Artificial Sequence
  Synthetic
aaaaaaatacagcgtttttcatgtacaactatactagttgtagtgcctaaaa

SEQ ID NO: 557 - DNA, 54 bp, Artificial Sequence
  Synthetic
ttgtaaaggagactgataatggcatgtacaactatactcgtcggtaaaaaggca

SEQ ID NO: 558 - DNA, 46 bp, Artificial Sequence
  Synthetic
tccagcccaacagtgttagtctttgctcttacccagttgggcggga

SEQ ID NO: 559 - DNA, 47 bp, Artificial Sequence
  Synthetic
gatcagctccgcgggcaagacctttctccttcacggggtggaaggtc

SEQ ID NO: 560 - DNA, 63 bp, Artificial Sequence
  Synthetic
ctagttttaaagttggttattagttactgtgatatttatcacggtacccaataaccaatgaat

SEQ ID NO: 561 - DNA, 71 bp, Artificial Sequence
  Synthetic
cggaaggtagcgtcaacgataggtgtaactgtcgtgtttgtaacggtacttccaacagctggcgccgccac

SEQ ID NO: 562 - DNA, 33 bp, Artificial Sequence
  Synthetic
caatgaaaaactaggcatgtagaagttgtttgt

SEQ ID NO: 563 - DNA, 32 bp, Artificial Sequence
  Synthetic
tttccacagacaactcacgtggaggtagtcac

SEQ ID NO: 564 - DNA, 56 bp, Artificial Sequence
  Synthetic
tgtagtaagtatcttaatatacagctttatctgttttttaagatacttactacttt

SEQ ID NO: 565 - DNA, 58 bp, Artificial Sequence
  Synthetic
cacccattgtgttcacaggagatacagctttatctgtactgatattaatgacatgctg

SEQ ID NO: 566 - DNA, 47 bp, Artificial Sequence
  Synthetic
agttgtggccatgtgtccatctgggggcagatggagacggggtcaca

SEQ ID NO: 567 - DNA, 50 bp, Artificial Sequence
  Synthetic
atctggatgtgggtgtccatctgcgggcagacgccgcagtcgaagcacgg

SEQ ID NO: 568 - DNA, 50 bp, Artificial Sequence
  Synthetic
accttgatctcggtgtccatcgccgggcagacgccgcagtcgaagcacgg

SEQ ID NO: 569 - DNA, 60 bp, Artificial Sequence
  Synthetic
ccctaatacgcaagtcgataactctcctgggagcgttgacaacttgcgcaccctgatctg

SEQ ID NO: 570 - DNA, 61 bp, Artificial Sequence
  Synthetic
gagcgccggatcagggagtggacggcctgggagcgctacacgctgtggctgcggtcggtgc

SEQ ID NO: 571 - DNA, 63 bp, Artificial Sequence
  Synthetic
gctcatgtatgtgtctacgcgagattctcgcccgagaacttctgcaaggcactgctcttggct

SEQ ID NO: 572 - DNA, 59 bp, Artificial Sequence
  Synthetic
ggacggcgcagaaggggagtagctcttcgccggaccgtcgacatactgctcagctcgtc

SEQ ID NO: 573 - DNA, 65 bp, Artificial Sequence
  Synthetic
atggataaaaaaatacagcgtttttcatgtacaactatactagttgtagtgcctaaataatgctt

SEQ ID NO: 574 - DNA, 62 bp, Artificial Sequence
  Synthetic
gtttgtaaaggagactgataatggcatgtacaactatactcgtcggtaaaaaggcatcttat

SEQ ID NO: 575 - DNA, 62 bp, Artificial Sequence
  Synthetic
aaaaattacaaagttttcaacccttgatttgaattagcggtcaaataatttgtaattcgttt

SEQ ID NO: 576 - DNA, 66 bp, Artificial Sequence
  Synthetic
ttccaaagagcgcccaacgcgacctgaaatttgaataagactgctgcttgtgtaaaggcgatgatt

SEQ ID NO: 577 - DNA, 66 bp, Artificial Sequence
  Synthetic
gtgttataaacctgtgtgagagttaagtttacatgcctaaccttaacttttacgcaggttcagctt

SEQ ID NO: 578 - DNA, 62 bp, Artificial Sequence
  Synthetic
agacgagaaacgttccgtccgtctgggtcagttgggcaaagttgatgaccgggtcgtccgtt

SEQ ID NO: 579 - DNA, 64 bp, Artificial Sequence
  Synthetic
ttaataaactatggaagtatgtacagtcttgcaatgttgagtgaacaaacttccataataaaat

SEQ ID NO: 580 - DNA, 65 bp, Artificial Sequence
  Synthetic
caatcatcagataactatggcggcacgtgcattaaccacggttgtatcccgtctaaagtactcgt

SEQ ID NO: 581 - DNA, 62 bp, Artificial Sequence
  Synthetic
gtggttgtttttgttggaagtgtgtatcaggtatctgcatagttattccgaacttccaatta

SEQ ID NO: 582 - DNA, 65 bp, Artificial Sequence
  Synthetic
tttatattgcgaaaaataattggcgaacgaggtaactggatacctcatccgccaattaaaatttg

SEQ ID NO: 583 - DNA, 62 bp, Artificial Sequence
  Synthetic
ggaaaatataaataattttagtaacctacatctcaatcaaggatagtaaaactctcactctt

SEQ ID NO: 584 - DNA, 62 bp, Artificial Sequence
  Synthetic
agcacgctgataatcagcaagaccaccaacatttccaccaatgtaaaagctttaaccttagc

SEQ ID NO: 585 - DNA, 65 bp, Artificial Sequence
  Synthetic
gtttatatgtttactaataagacgctctcaacccataaagtcttattagtaaacatatttcaact

SEQ ID NO: 586 - DNA, 65 bp, Artificial Sequence
  Synthetic
atggattttgcagattcccagatgcccctacagaaagaggtacaaaacatttattggaattaatt

SEQ ID NO: 587 - DNA, 65 bp, Artificial Sequence
  Synthetic
tttttgtatgttagttgtgtcactgggtagacctaaatagtgacacaactgctattaaaatttaa

SEQ ID NO: 588 - DNA, 66 bp, Artificial Sequence
  Synthetic
gttcgtggtaactatgggtggtacaggtgccacattagttgtaccatttatgtttatgtggttaac

SEQ ID NO: 589 - DNA, 64 bp, Artificial Sequence
  Synthetic
caataacggttgtatttgtagaacttgaccagttgttttagtaacataaatacaactccgaata

SEQ ID NO: 590 - DNA, 64 bp, Artificial Sequence
  Synthetic
gcatacattgttgttgtttttccagatccagttggtcctgtaaatataagcaatccatgtgagt

SEQ ID NO: 591 - DNA, 52 bp, Artificial Sequence
  Synthetic
gtttagtatctcgttatctctcgttggagggagaagaaacgggataccaaaa

SEQ ID NO: 592 - DNA, 52 bp, Artificial Sequence
  Synthetic
taactttttcggatcgagttatgatggacgtaaagagggaacaaagcatcta

SEQ ID NO: 593 - DNA, 52 bp, Artificial Sequence
  Synthetic
tagtttccaatgttacaggaactgctggcagaatccaacacattggaagtcg

SEQ ID NO: 594 - DNA, 42 bp, Artificial Sequence
  Synthetic
cggtctccatcgggatctgctgatcgagcagcatgccgacca

SEQ ID NO: 595 - DNA, 52 bp, Artificial Sequence
  Synthetic
taaccgcaagtgtacatccctcggctggccgagacaagtacagttgcgacag

SEQ ID NO: 596 - DNA, 42 bp, Artificial Sequence; identical to SEQ ID NO: 594
  Synthetic

SEQ ID NO: 597 - DNA, 52 bp, Artificial Sequence
  Synthetic
atgtggtcctttagatccactgacgtgggtcagtgtctctaaaggactcgcg

SEQ ID NO: 598 - DNA, 53 bp, Artificial Sequence
  Synthetic
catcagggcggtcaggccgtagatgtggaagaaacggcagcacggcgaggacg

SEQ ID NO: 599 - DNA, 32 bp, Artificial Sequence
  Synthetic
cgtttcctgtaaaccgaggttttggataaaca

SEQ ID NO: 600 - DNA, 32 bp, Artificial Sequence
  Synthetic
cgtttcctgtaaaccgaggttttggataatgg

SEQ ID NO: 601 - DNA, 32 bp, Artificial Sequence
  Synthetic
gagttctcttaaaccaaggtttaggattgaaa

SEQ ID NO: 602 - DNA, 32 bp, Artificial Sequence
  Synthetic
gagttctcttaaaccaaggtattggataacag

SEQ ID NO: 603 - DNA, 32 bp, Artificial Sequence
  Synthetic
tggttcttgaaaaccaaggtttttgataaagc

SEQ ID NO: 604 - DNA, 33 bp, Artificial Sequence
  Synthetic
aaattttcctttttggaaggtttttgataacca

SEQ ID NO: 605 - DNA, 32 bp, Artificial Sequence
  Synthetic
gccttcccctaaaccaacgtttttatgccgcc

SEQ ID NO: 606 - DNA, 32 bp, Artificial Sequence
  Synthetic
gccttcccccaaaccaaggtaatcaagaacgc

SEQ ID NO: 607 - DNA, 32 bp, Artificial Sequence
  Synthetic
ttgtgaaatttgggtacaccctaatcatacaa

SEQ ID NO: 608 - DNA, 26 bp, Artificial Sequence
  Synthetic
cgtatgattagggtgtatattaattt

SEQ ID NO: 609 - DNA, 101 bp, Artificial Sequence
  Synthetic
caaatgattttattttgactaataatgacctacttacattaatttactgataattaaagagattttaaatatacaacttattcacctaaaggatgacaaaa

SEQ ID NO: 610 - DNA, 21 bp, Artificial Sequence
  Synthetic
gcactttaggtgaaaaaggtt

SEQ ID NO: 611 - DNA, 126 bp, Artificial Sequence
  Synthetic
taacattaatcacttaaaaatcatcgcattacactaatctgtggttaaatgatagactacataatgcgacaaaacgcaacatatccagtcactatgaatcaactacttagatagtattagtgacct

SEQ ID NO: 612 - DNA, 259 bp, Artificial Sequence
  Synthetic
ctaagtggtttgggacaaaaatgggacatacaaatctttgcatcggtttgcaaggctttgcatgtctttcgaagatgggacgtgtgagcgcaggtatgacgtggtatgtgttgacttaaaaggtagttcttataattcgtaatgcgaaggtcgtaggttcgactcctattatcggcaccagttaaatcaaatacttacgtattattcgtgccttccttatttttactgtgggacatatttgggacagaagtaccaaaaa

SEQ ID NO: 613 - DNA, 27 bp, Artificial Sequence
  Synthetic
gcagcgcattcgtaatgcgaaggtcgt

SEQ ID NO: 614 - DNA, 412 bp, Artificial Sequence
  Synthetic
gcgatccccatccgcgacgtgccaactaggtctcctctcgtcgtgaacaaggctaccgggttgcaactcctgtgcaactctcaggcttcaacgcgcttctacgacctgcaatttctttccacttagaggatgcagccgagaggggtaaaaacctatcttgaccggcccatatgtggtcggcagacacccattcttccaaactagctacgcgggttcgattcccgtcgcccgctccgctggtcagagggtgttttcgccctctggccatttttctttccaggggtctgcaactcttgtgcgactcttctgacctgggcatacgcggttgcaacgcatccctgatctggctactttcgatgctgacaaacgaatagagccccccgcctgcgcgaacagacgaggggcattcaca

SEQ ID NO: 615 - DNA, 43 bp, Artificial Sequence
  Synthetic
gagcgggcgacgggaatcgaacccgcgtagctagtttggaaga

SEQ ID NO: 616 - DNA, 20 bp, Artificial Sequence
  Synthetic
gtcaaccagtatcccggtgc

SEQ ID NO: 617 - DNA, 20 bp, Artificial Sequence
  Synthetic
ggggtcccaggtgctgacgt

SEQ ID NO: 618 - DNA, 21 bp, Artificial Sequence
  Synthetic
gatgtacagagagcccagggc

SEQ ID NO: 619 - DNA, 20 bp, Artificial Sequence
  Synthetic
gtcaaccagtatcccggtgc

SEQ ID NO: 620 - DNA, 21 bp, Artificial Sequence
  Synthetic
gatgtacagagagcccagggc

SEQ ID NO: 621 - DNA, 20 bp, Artificial Sequence
  Synthetic
ggggtcccaggtgctgacgt

SEQ ID NO: 622 - protein, 4 aa, Artificial Sequence
  Synthetic
FCPF

SEQ ID NO: 623-624 - skipped (2 entries)

SEQ ID NO: 625 - DNA, 209 bp, Artificial Sequence
  Synthetic
ttcattcagcaagttcagagaaatctgaacttgctggatttttggagcagggagatggaataggagcttgctccgtccactccacgcatcgacctggtattgcagtacctccaggaacggtgcacccactttctggagtttcaaaagtagactgtacgctaagggtcatatctttttttgtttggtttgtgtcttggttggcgtcttaa

SEQ ID NO: 626 - DNA, 21 bp, Artificial Sequence
  Synthetic
gccttgataccaacctgccca

SEQ ID NO: 627 - DNA, 21 bp, Artificial Sequence
  Synthetic
gctggaactggtcaccaaggc

SEQ ID NO: 628 - DNA, 21 bp, Artificial Sequence
  Synthetic
gtacctgaaccgtatatccta

SEQ ID NO: 629 - DNA, 21 bp, Artificial Sequence
  Synthetic
gtacctgaaccgtatatctta

SEQ ID NO: 630 - protein, 535 aa, Artificial Sequence; identical to SEQ ID NO: 398
  Synthetic

SEQ ID NO: 631 - skipped

SEQ ID NO: 632 - DNA, 20 bp, Artificial Sequence
  Synthetic
ggcccagactgagcacgtga

SEQ ID NO: 633 - DNA, 20 bp, Artificial Sequence
  Synthetic
ggcccagactgagcacgtga

SEQ ID NO: 634 - DNA, 20 bp, Artificial Sequence
  Synthetic
ggcccagactgagcacgtga

SEQ ID NO: 635 - DNA, 20 bp, Artificial Sequence
  Synthetic
ggcccagactgagcacgtga

SEQ ID NO: 636 - DNA, 20 bp, Artificial Sequence
  Synthetic
ggcccagactgagcacgtga

SEQ ID NO: 637 - DNA, 20 bp, Artificial Sequence
  Synthetic
gtcatcttagtcattacctg

SEQ ID NO: 638 - DNA, 20 bp, Artificial Sequence
  Synthetic
gtcatcttagtcattacctg

SEQ ID NO: 639 - DNA, 20 bp, Artificial Sequence
  Synthetic
gtcatcttagtcattacctg

SEQ ID NO: 640 - DNA, 21 bp, Artificial Sequence
  Synthetic
gcatggtgcacctgactcctg

SEQ ID NO: 641 - DNA, 23 bp, Artificial Sequence
  Synthetic
tctgccatcccgtgctcagtctg

SEQ ID NO: 642 - DNA, 23 bp, Artificial Sequence
  Synthetic
tctgccagcacgtgctcagtctg

SEQ ID NO: 643 - DNA, 23 bp, Artificial Sequence
  Synthetic
tctgccaacacgtgctcagtctg

SEQ ID NO: 644 - DNA, 47 bp, Artificial Sequence
  Synthetic
tggaggaagcagggcttcctttcctctgaaaacacgtgctcagtctg

SEQ ID NO: 645 - DNA, 26 bp, Artificial Sequence
  Synthetic
tctgccatcaaagcgtgctcagtctg

SEQ ID NO: 646 - DNA, 29 bp, Artificial Sequence
  Synthetic
aacgaacacctcatgtaatgactaagatg

SEQ ID NO: 647 - DNA, 29 bp, Artificial Sequence
  Synthetic
aacgaacacctcacgtaatgactaagatg

SEQ ID NO: 648 - DNA, 32 bp, Artificial Sequence
  Synthetic
aacgaacacctcagtacgtaatgactaagatg

SEQ ID NO: 649 - DNA, 27 bp, Artificial Sequence
  Synthetic
agacttctccacaggagtcaggtgcac

SEQ ID NO: 650-659 - skipped (10 entries)

SEQ ID NO: 660 - protein, 1803 aa, Artificial Sequence; identical to SEQ ID NO: 162
  Synthetic

SEQ ID NO: 661 - protein, 2117 aa, Artificial Sequence; identical to SEQ ID NO: 163
  Synthetic

SEQ ID NO: 662 - protein, 2117 aa, Artificial Sequence; identical to SEQ ID NO: 164
  Synthetic

SEQ ID NO: 663 - DNA, 20 bp, Artificial Sequence
  Synthetic
ggcccagactgagcacgtga

SEQ ID NO: 664 - DNA, 20 bp, Artificial Sequence
  Synthetic
ggcccagactgagcacgtga

SEQ ID NO: 665 - DNA, 20 bp, Artificial Sequence
  Synthetic
ggcccagactgagcacgtga

SEQ ID NO: 666 - DNA, 20 bp, Artificial Sequence
  Synthetic
ggcccagactgagcacgtga

SEQ ID NO: 667 - DNA, 20 bp, Artificial Sequence
  Synthetic
ggcactgcggctggaggtgg

SEQ ID NO: 668 - DNA, 20 bp, Artificial Sequence
  Synthetic
ggcactgcggctggaggtgg

SEQ ID NO: 669 - DNA, 20 bp, Artificial Sequence
  Synthetic
ggcactgcggctggaggtgg

SEQ ID NO: 670 - DNA, 20 bp, Artificial Sequence
  Synthetic
ggcactgcggctggaggtgg

SEQ ID NO: 671 - DNA, 20 bp, Artificial Sequence
  Synthetic
gagtccgagcagaagaagaa

SEQ ID NO: 672 - DNA, 20 bp, Artificial Sequence
  Synthetic
gagtccgagcagaagaagaa

SEQ ID NO: 673 - DNA, 20 bp, Artificial Sequence
  Synthetic
gagtccgagcagaagaagaa

SEQ ID NO: 674 - DNA, 20 bp, Artificial Sequence
  Synthetic
gagtccgagcagaagaagaa

SEQ ID NO: 675 - DNA, 20 bp, Artificial Sequence
  Synthetic
ggaatcccttctgcagcacc

SEQ ID NO: 676 - DNA, 20 bp, Artificial Sequence
  Synthetic
ggaatcccttctgcagcacc

SEQ ID NO: 677 - DNA, 20 bp, Artificial Sequence
  Synthetic
ggaatcccttctgcagcacc

SEQ ID NO: 678 - DNA, 23 bp, Artificial Sequence
  Synthetic
tctgccatctcgtgctcagtctg

SEQ ID NO: 679 - DNA, 26 bp, Artificial Sequence
  Synthetic
tctgccatcaaagcgtgctcagtctg

SEQ ID NO: 680 - DNA, 22 bp, Artificial Sequence
  Synthetic
tctgccatccgtgctcagtctg

SEQ ID NO: 681 - DNA, 23 bp, Artificial Sequence
  Synthetic
tctgcgatcacgtgctcagtctg

SEQ ID NO: 682 - DNA, 19 bp, Artificial Sequence
  Synthetic
ttaacgcccacctccagcc

SEQ ID NO: 683 - DNA, 19 bp, Artificial Sequence
  Synthetic
ttaacccccccctccagcc

SEQ ID NO: 684 - DNA, 22 bp, Artificial Sequence
  Synthetic
ttaaccccttacacctccagcc

SEQ ID NO: 685 - DNA, 18 bp, Artificial Sequence
  Synthetic
ttaaccccccctccagcc

SEQ ID NO: 686 - DNA, 30 bp, Artificial Sequence
  Synthetic
gtgatgggagcacttcttcttctgctcgga

SEQ ID NO: 687 - DNA, 30 bp, Artificial Sequence
  Synthetic
gtgatgggagccctgcttcttctgctcgga

SEQ ID NO: 688 - DNA, 33 bp, Artificial Sequence
  Synthetic
gtgatgggagcccttcgcattcttctgctcgga

SEQ ID NO: 689 - DNA, 27 bp, Artificial Sequence
  Synthetic
gtgatgggagttcttcttctgctcgga

SEQ ID NO: 690 - DNA, 31 bp, Artificial Sequence
  Synthetic
ggaaaagcgatgcaggtgctgcagaagggat

SEQ ID NO: 691 - DNA, 31 bp, Artificial Sequence
  Synthetic
ggaaaagcgatccaggcgctgcagaagggat

SEQ ID NO: 692 - DNA, 34 bp, Artificial Sequence
  Synthetic
ggaaaagcgatccaatcggtgctgcagaagggat

SEQ ID NO: 693-699 - skipped (7 entries)

SEQ ID NO: 700 - protein, 677 aa, Unknown; identical to SEQ ID NO: 89
  moloney murine leukemia virus

SEQ ID NO: 701 - protein, 677 aa, Artificial Sequence; identical to SEQ ID NO: 106
  Synthetic

SEQ ID NO: 702 - protein, 677 aa, Artificial Sequence; identical to SEQ ID NO: 107
  Synthetic

SEQ ID NO: 703 - protein, 677 aa, Artificial Sequence; identical to SEQ ID NO: 109
  Synthetic

SEQ ID NO: 704 - protein, 677 aa, Artificial Sequence; identical to SEQ ID NO: 110
  Synthetic

SEQ ID NO: 705 - protein, 677 aa, Artificial Sequence; identical to SEQ ID NO: 111
  Synthetic

SEQ ID NO: 706 - protein, 677 aa, Artificial Sequence; identical to SEQ ID NO: 112
  Synthetic

SEQ ID NO: 707 - protein, 677 aa, Artificial Sequence; identical to SEQ ID NO: 113
  Synthetic

SEQ ID NO: 708 - protein, 677 aa, Artificial Sequence; identical to SEQ ID NO: 114
  Synthetic

SEQ ID NO: 709 - protein, 677 aa, Artificial Sequence; identical to SEQ ID NO: 115
  Synthetic

SEQ ID NO: 710 - protein, 677 aa, Artificial Sequence; identical to SEQ ID NO: 116
  Synthetic

SEQ ID NO: 711 - protein, 677 aa, Artificial Sequence; identical to SEQ ID NO: 117
  Synthetic

SEQ ID NO: 712 - protein, 677 aa, Artificial Sequence; identical to SEQ ID NO: 118
  Synthetic

SEQ ID NO: 713 - protein, 677 aa, Artificial Sequence; identical to SEQ ID NO: 119
  Synthetic

SEQ ID NO: 714 - protein, 677 aa, Artificial Sequence; identical to SEQ ID NO: 120
  Synthetic

SEQ ID NO: 715 - protein, 677 aa, Artificial Sequence; identical to SEQ ID NO: 121
  Synthetic

SEQ ID NO: 716 - protein, 677 aa, Artificial Sequence; identical to SEQ ID NO: 122
  Synthetic

SEQ ID NO: 717 - DNA, 100 bp, Artificial Sequence
  Synthetic
gcttctccagccctggcctgggtcaatccttggggcccagactgagcacgtgttggcagaggaaaggaagccctgcttcctccagagggcgtcgcaggac

SEQ ID NO: 718 - DNA, 100 bp, Artificial Sequence
  Synthetic
gcttctccagccctggcctgggtcaatccttggggcccagactgagcacgtgttttcagaggaaaggaagccctgcttcctccagagggcgtcgcaggac

SEQ ID NO: 719 - DNA, 100 bp, Artificial Sequence
  Synthetic
gcttctccagccctggcctgggtcaatccttggggcccagactgagcacgggatggcagaggaaaggaagccctgcttcctccagagggcgtcgcaggac

SEQ ID NO: 720 - DNA, 100 bp, Artificial Sequence
  Synthetic
gcttctccagccctggcctgggtcaatccttggggcccagactgagcacgtgctggcagaggaaaggaagccctgcttcctccagagggcgtcgcaggac

SEQ ID NO: 721 - DNA, 103 bp, Artificial Sequence
  Synthetic
gcttctccagccctggcctgggtcaatccttggggcccagactgagcacgctttgatggcagaggaaaggaagccctgcttcctccagagggcgtcgcaggac

SEQ ID NO: 722 - DNA, 100 bp, Artificial Sequence
  Synthetic
cccagtttacacgtctcatatgccccttggcagtcatcttagtcattacatgaggtgttcgttgtaactcatataaactgagttcccatgttttgcttaa

SEQ ID NO: 723 - DNA, 100 bp, Artificial Sequence
  Synthetic
cccagtttacacgtctcatatgccccttggcagtcatcttagtcattacgtgaggtgttcgttgtaactcatataaactgagttcccatgttttgcttaa

SEQ ID NO: 724 - DNA, 100 bp, Artificial Sequence
  Synthetic
cagtttacacgtctcatatgccccttggcagtcatcttagtcattacgtactgaggtgttcgttgtaactcatataaactgagttcccatgttttgctta

SEQ ID NO: 725 - DNA, 100 bp, Artificial Sequence
  Synthetic
acttcatccacgttcaccttgccccacagggcagtaacggcagacttctccacaggagtcagatgcaccatggtgtctgtttgaggttgctagtgaacac

SEQ ID NO: 726 - DNA, 100 bp, Artificial Sequence
  Synthetic
acttcatccacgttcaccttgccccacagggcagtaacggcagacttctcctcaggagtcaggtgcaccatggtgtctgtttgaggttgctagtgaacac

SEQ ID NO: 727 - DNA, 100 bp, Artificial Sequence
  Synthetic
gtgttcactagcaacctcaaacagacaccatggtgcacctgactcctgaggagaagtctgccgttactgccctgtggggcaaggtgaacgtggatgaagt

SEQ ID NO: 728 - DNA, 100 bp, Artificial Sequence
  Synthetic
gtgttcactagcaacctcaaacagacaccatggtgcacctgactcctgatgagaagtctgccgttactgccctgtggggcaaggtgaacgtggatgaagt

SEQ ID NO: 729 - DNA, 100 bp, Artificial Sequence
  Synthetic
cacatggctggtgctgcagcagctggggcagtggtggggggccttggcgtctacatgctgggaagtgccatgagcaggcccatcatacatttcggcagtg

SEQ ID NO: 730 - DNA, 9224 bp, Artificial Sequence
  Synthetic
atgtctaaaggtgaagaattattcactggtgttgtcccaattttggttgaattagatggtgatgttaatggtcacaaattttctgtctccggtgaaggtgaaggtgatgctacttacggtaaattgaccttaaaatttatttgtactactggtaaattgccagttccatggccaaccttagtcactactttcggttatggtgttcaatgttttgctagatacccagatcatatgaaacaacatgactttttcaagtctgccatgccagaaggttatgttcaagaaagaactatttttttcaaagatgacggtaactacaagaccagagctgaagtcaagtttgaaggtgataccttagttaatagaatcgaattaaaaggtattgattttaaagaagatggtaacattttaggtcacaaattggaatacaactataactctcacaatgtttacatcatggctgacaaacaaaagaatggtatcaaagttaacttcaaaattagacacaacattgaagatggttctgttcaattagctgaccattatcaacaaaatactccaattggtgatggtccagtcttgttaccagacaaccattacttatccactcaatctgccttatccaaagatccaaacgaaaagagagaccacatggtcttgttagaatttgttactgctgctggtattacccatggtatggatgaattgtacaaagctagcaacctgggtcaatccttggggcccagactgagcacgtgatggcagagcacaggagacgtcatggtttcaaaaggtgaagaagataatatggctattattaaagaatttatgagatttaaagttcatatggaaggttcagttaatggtcatgaatttgaaattgaaggtgaaggtgaaggtagaccatatgaaggtactcaaactgctaaattgaaagttactaaaggtggtccattaccatttgcttgggatattttgtcaccacaatttatgtatggttcaaaagcttatgttaaacatccagctgatattccagattatttaaaattgtcatttccagaaggttttaaatgggaaagagttatgaattttgaagatggtggtgttgttactgttactcaagattcatcattacaagatggtgaatttatttataaagttaaattgagaggtactaattttccatcagatggtccagttatgcaaaaaaaaactatgggttgggaagcttcatcagaaagaatgtatccagaagatggtgctttaaaaggtgaaattaaacaaagattgaaattaaaagatggtggtcattatgatgctgaagttaaaactacttataaagctaaaaaaccagttcaattaccaggtgcttataatgttaatattaaattggatattacttcacataatgaagattatactattgttgaacaatatgaaagagctgaaggtagacattcaactggtggtatggatgaattatataaaggtaccgctcgagcagctgtgattgattgagtcgacttggttgaacacgttgccaaggcttaagtgaatttactttaaatcttgcatttaaataaattttctttttatagctttatgacttagtttcaatttatatactattttaatgacattttcgattcggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaagaattc

SEQ ID NO: 731 - DNA, 9225 bp, Artificial Sequence
  Synthetic
atgtctaaaggtgaagaattattcactggtgttgtcccaattttggttgaattagatggtgatgttaatggtcacaaattttctgtctccggtgaaggtgaaggtgatgctacttacggtaaattgaccttaaaatttatttgtactactggtaaattgccagttccatggccaaccttagtcactactttcggttatggtgttcaatgttttgctagatacccagatcatatgaaacaacatgactttttcaagtctgccatgccagaaggttatgttcaagaaagaactatttttttcaaagatgacggtaactacaagaccagagctgaagtcaagtttgaaggtgataccttagttaatagaatcgaattaaaaggtattgattttaaagaagatggtaacattttaggtcacaaattggaatacaactataactctcacaatgtttacatcatggctgacaaacaaaagaatggtatcaaagttaacttcaaaattagacacaacattgaagatggttctgttcaattagctgaccattatcaacaaaatactccaattggtgatggtccagtcttgttaccagacaaccattacttatccactcaatctgccttatccaaagatccaaacgaaaagagagaccacatggtcttgttagaatttgttactgctgctggtattacccatggtatggatgaattgtacaaagctagcaaacctgggtcaatccttggggcccagactgagcacgtgatggcagagcacaggagacgtcatggtttcaaaaggtgaagaagataatatggctattattaaagaatttatgagatttaaagttcatatggaaggttcagttaatggtcatgaatttgaaattgaaggtgaaggtgaaggtagaccatatgaaggtactcaaactgctaaattgaaagttactaaaggtggtccattaccatttgcttgggatattttgtcaccacaatttatgtatggttcaaaagcttatgttaaacatccagctgatattccagattatttaaaattgtcatttccagaaggttttaaatgggaaagagttatgaattttgaagatggtggtgttgttactgttactcaagattcatcattacaagatggtgaatttatttataaagttaaattgagaggtactaattttccatcagatggtccagttatgcaaaaaaaaactatgggttgggaagcttcatcagaaagaatgtatccagaagatggtgctttaaaaggtgaaattaaacaaagattgaaattaaaagatggtggtcattatgatgctgaagttaaaactacttataaagctaaaaaaccagttcaattaccaggtgcttataatgttaatattaaattggatattacttcacataatgaagattatactattgttgaacaatatgaaagagctgaaggtagacattcaactggtggtatggatgaattatataaaggtaccgctcgagcagctgtgattgattgagtcgacttggttgaacacgttgccaaggcttaagtgaatttactttaaatcttgcatttaaataaattttctttttatagctttatgacttagtttcaatttatatactattttaatgacattttcgattcggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaagaattc

SEQ ID NO: 732 - DNA, 9223 bp, Artificial Sequence
  Synthetic
atgtctaaaggtgaagaattattcactggtgttgtcccaattttggttgaattagatggtgatgttaatggtcacaaattttctgtctccggtgaaggtgaaggtgatgctacttacggtaaattgaccttaaaatttatttgtactactggtaaattgccagttccatggccaaccttagtcactactttcggttatggtgttcaatgttttgctagatacccagatcatatgaaacaacatgactttttcaagtctgccatgccagaaggttatgttcaagaaagaactatttttttcaaagatgacggtaactacaagaccagagctgaagtcaagtttgaaggtgataccttagttaatagaatcgaattaaaaggtattgattttaaagaagatggtaacattttaggtcacaaattggaatacaactataactctcacaatgtttacatcatggctgacaaacaaaagaatggtatcaaagttaacttcaaaattagacacaacattgaagatggttctgttcaattagctgaccattatcaacaaaatactccaattggtgatggtccagtcttgttaccagacaaccattacttatccactcaatctgccttatccaaagatccaaacgaaaagagagaccacatggtcttgttagaatttgttactgctgctggtattacccatggtatggatgaattgtacaaagctagcaaacctgggtcaatccttggggcccagactgagcacgtgatggcagagcacaggacgtcatggtttcaaaaggtgaagaagataatatggctattattaaagaatttatgagatttaaagttcatatggaaggttcagttaatggtcatgaatttgaaattgaaggtgaaggtgaaggtagaccatatgaaggtactcaaactgctaaattgaaagttactaaaggtggtccattaccatttgcttgggatattttgtcaccacaatttatgtatggttcaaaagcttatgttaaacatccagctgatattccagattatttaaaattgtcatttccagaaggttttaaatgggaaagagttatgaattttgaagatggtggtgttgttactgttactcaagattcatcattacaagatggtgaatttatttataaagttaaattgagaggtactaattttccatcagatggtccagttatgcaaaaaaaaactatgggttgggaagcttcatcagaaagaatgtatccagaagatggtgctttaaaaggtgaaattaaacaaagattgaaattaaaagatggtggtcattatgatgctgaagttaaaactacttataaagctaaaaaaccagttcaattaccaggtgcttataatgttaatattaaattggatattacttcacataatgaagattatactattgttgaacaatatgaaagagctgaaggtagacattcaactggtggtatggatgaattatataaaggtaccgctcgagcagctgtgattgattgagtcgacttggttgaacacgttgccaaggcttaagtgaatttactttaaatcttgcatttaaataaattttctttttatagctttatgacttagtttcaatttatatactattttaatgacattttcgattcggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaagaattc

SEQ ID NO: 733 - DNA, 9753 bp, Artificial Sequence
  Synthetic
atgaaacggacagccgacggaagcgagttcgagtcaccaaagaagaagcggaaagtcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccctgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgagaaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 734 - DNA, 9753 bp, Artificial Sequence
  Synthetic
atgaaacggacagccgacggaagcgagttcgagtcaccaaagaagaagcggaaagtcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttaatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggaaggcaggcttctgtcgcctcttcatccctgggtttgcagaaatggcagcccccctgtaccctctcaccaaaccggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggtggctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgagaaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccacc

SEQ ID NO: 735 - DNA, 2305 bp, Artificial Sequence
  Synthetic
gagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggcccagactgagcacgtgagttttagagctagaaatagcaagttaaaataaggctagtccgttatcaacttgaaaaagtgggaccgagtcggtcctctgccatcaaagcgtgctcagtctgtttttttaagcttgggccgctcgaggtacctctctacatatgacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgctagctgtacaaaaaagcaggctttaaaggaaccaattcagtcgactggatccggtaccaaggtcgggcaggaa

SEQ ID NO: 736 - DNA, 11591 bp, Artificial Sequence
  Synthetic
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattaaggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcgggctggagctgttcgcgcgttttagagctagaaatagcaagttaaaataaggctagtccgttatcaacttgaaaaagtggcaccgagtcggtgcaagatgcaagcgcgaacagctccagtttttttgaattcagtgcaagtgggttttaggaccaggatgaggcggggtgggggtgcctacctgacgaccgaccccgacccactggacaagcacccaacccccattccccaaattgcgcatcccctatcagagagggggaggggaaacaggatgcggcgaggcgcgtgcgcactgccagcttcagcaccgcggacagtgccttcgcccccgcctggcggcgcgcgccaccgccgcctcagcactgaaggcgcgctgacgtcactcgccggtcccccgcaaactccccttcccggccaccttggtcgcgtccgcgccgccgccggcccagccggaccgcaccacgcgaggcgcgagataggggggcacgggcgcgaccatctgcgctgcggcgccggcgactcagcgctgcctcagtctgcggtgggcagcggaggagtcgtgtcgtgcctgagagcgcagtcgagaatctagagcgctgccaccatgaaacggacagccgacggaagcgagttcgagtcaccaaagaagaagcggaaagtcgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgacgagattttcgagcgggagctggacctgatgagagtggataacctgcctaatagcggaggcagtaaaagaacagcagacgggagtgagtttgagcccaagaaaaagagaaaggtgggatccggcgcaacaaacttctctctgctgaaacaagccggagatgtcgaagagaatcctggaccggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagaggaggaggaggagacagacagcaggatgccccacctcgacagccccggcagctcccagccgagacgctccttcctctcaagggtgatcagggcagcgctaccgttgcagctgcttctgctgctgctgctgctcctggcctgcctgctacctgcctctgaagatgactacagctgcacccaggccaacaactttgcccgatccttctaccccatgctgcggtacaccaacgggccacctcccacctaaacgcgttaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcgtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 737 - skipped

SEQ ID NO: 738 - DNA, 8323 bp, Artificial Sequence
  Synthetic
taacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgccgcgcgcgcgaaaaagccggttttagagctagaaatagcaagttaaaataaggctagtccgttatcaacttgaaaaagtggcaccgagtcggtgcttttttaagcttggcgtaactagatcttgagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccactttggcgccggctcgagggggcccgggtgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgccgtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgaacgcgttaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcgtcgactttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtacgtatagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaaca

SEQ ID NO: 739 - protein, 677 aa, Unknown; identical to SEQ ID NO: 89
  moloney murine leukemia virus

SEQ ID NO: 740 - protein, 677 aa, Artificial Sequence; identical to SEQ ID NO: 108
  Synthetic

SEQ ID NO: 741 - protein, 677 aa, Artificial Sequence; identical to SEQ ID NO: 122
  Synthetic

SEQ ID NO: 742 - protein, 677 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKLPGTNDYSPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSP

SEQ ID NO: 743 - DNA, 41 bp, Artificial Sequence
  Synthetic
cgtatcggtaactgatccgatggaaagccagttcagaaccg

SEQ ID NO: 744 - DNA, 41 bp, Artificial Sequence
  Synthetic
cgtatcggtaactgatccgatggaatgccaggtcagaaccg

SEQ ID NO: 745 - DNA, 41 bp, Artificial Sequence
  Synthetic
cgtatcggtaactgatccgatggaatgccaggtcaaaacgg

SEQ ID NO: 746 - DNA, 41 bp, Artificial Sequence; identical to SEQ ID NO: 743
  Synthetic

SEQ ID NO: 747 - DNA, 38 bp, Artificial Sequence
  Synthetic
cgtatcggtaactgatccgatgggccagttcagaaccg

SEQ ID NO: 748 - DNA, 35 bp, Artificial Sequence
  Synthetic
cgtatcggtaactgatccgatggagttcagaaccg

SEQ ID NO: 749 - DNA, 23 bp, Artificial Sequence
  Synthetic
cgtatcgtatcgtatcgtattgg

SEQ ID NO: 750 - DNA, 28 bp, Artificial Sequence
  Synthetic
cgtatcgtatcgtatcgtatcgtattgg

SEQ ID NO: 751 - DNA, 33 bp, Artificial Sequence
  Synthetic
cgtatcgtatcgtatcgtatcgtatcgtattgg

SEQ ID NO: 752 - DNA, 26 bp, Artificial Sequence
  Synthetic
cgtatcggtaactgatccgatggaaa

SEQ ID NO: 753 - DNA, 53 bp, Artificial Sequence
  Synthetic
gcgtatcggtaactgatccgatttccatcggggccaggagatcagttaccgat

SEQ ID NO: 754 - DNA, 36 bp, Artificial Sequence
  Synthetic
cgtatcggtaactgaatctcctggccccgatggaaa

SEQ ID NO: 755 - DNA, 53 bp, Artificial Sequence
  Synthetic
gcgtatcggtaactgatctccgggccaggatttccatcggatcagttaccgat

SEQ ID NO: 756 - DNA, 44 bp, Artificial Sequence
  Synthetic
cgtatcggtaactgatccgatggaaatcctggccccgatggaaa

SEQ ID NO: 757 - DNA, 905 bp, Artificial Sequence; identical to SEQ ID NO: 223
  Synthetic

SEQ ID NO: 758 - DNA, 942 bp, Artificial Sequence; identical to SEQ ID NO: 224
  Synthetic

SEQ ID NO: 759 - DNA, 1370 bp, Artificial Sequence; identical to SEQ ID NO: 225
  Synthetic

SEQ ID NO: 760 - DNA, 807 bp, Artificial Sequence; identical to SEQ ID NO: 226
  Synthetic

SEQ ID NO: 761 - DNA, 743 bp, Artificial Sequence; identical to SEQ ID NO: 227
  Synthetic

SEQ ID NO: 762 - DNA, 98 bp, Artificial Sequence
  Synthetic
gccaacatgaggatcacccatgtctgcagggcctggaggaagcagggcttcctttcctctgccatcaatgatggtgatgatggtgcgtgctcagtctg

SEQ ID NO: 763 - DNA, 33 bp, Artificial Sequence
  Synthetic
gccaacatgaggatcacccatgtctgcagggcc

SEQ ID NO: 764 - protein, 131 aa, Artificial Sequence
  Synthetic
GSASNFTQFVLVDNGGTGDVTVAPSNFANGVAEWISSNSRSQAYKVTCSVRQSSAQNRKYTIKVEVPKVATQTVGGEELPVAGWRSYLNMELTIPIFATNSDCELIVKAMQGLLKDGNPIPSAIAANSGIY

SEQ ID NO: 765 - protein, 1943 aa, Artificial Sequence
  Synthetic
MKRTADGSEFESPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDNSRLINSGGSKRTADGSEFEPKKKRKV

SEQ ID NO: 766 - protein, 503 aa, Artificial Sequence
  Synthetic
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDNSRLIN

SEQ ID NO: 767 - protein, 3 aa, Artificial Sequence
  Synthetic
GGS

SEQ ID NO: 768 - protein, 6 aa, Artificial Sequence
  Synthetic
GGSGGS

SEQ ID NO: 769 - protein, 9 aa, Artificial Sequence
  Synthetic
GGSGGSGGS

SEQ ID NO: 770-772 - skipped (3 entries)

SEQ ID NO: 773 - DNA, 102 bp, Artificial Sequence
  Synthetic
gccaacatgaggatcacccatgtctgcagggcctggaggaagcagggcttcctttcctctgccatcaatgatggtgatgatggtgcgtgctcagtctgggcc

SEQ ID NO: 774 - DNA, 112 bp, Artificial Sequence
  Synthetic
ggaggaagcagggcttcctttcctctgccatcaatgatggtgatgatggtgcgtgctcagtctgaaattaacaaatcaagccaacatgaggatcacccatgtctgcagggcc

SEQ ID NO: 775 - DNA, 116 bp, Artificial Sequence
  Synthetic
ggaggaagcagggcttcctttcctctgccatcaatgatggtgatgatggtgcgtgctcagtctgggccaaattaacaaatcaagccaacatgaggatcacccatgtctgcagggcc

SEQ ID NO: 776 - DNA, 148 bp, Artificial Sequence
  Synthetic
ggcccagactgagcacgtgagttttagagctaggccaacatgaggatcacccatgtctgcagggcctagcaagttaaaataaggctagtccgttatcaacttgaaaaagtgggaccgagtcggtcctctgccatctcgtgctcagtct

SEQ ID NO: 777 - DNA, 148 bp, Artificial Sequence
  Synthetic
ggcccagactgagcacgtgagttttagagctagaaatagcaagttaaaataaggctagtccgttatcaacttggccaacatgaggatcacccatgtctgcagggccaagtgggaccgagtcggtcctctgccatctcgtgctcagtct

SEQ ID NO: 778 - protein, 2281 aa, Artificial Sequence
  Synthetic
MKRTADGSEFESPKKKRKVGSASNFTQFVLVDNGGTGDVTVAPSNFANGVAEWISSNSRSQAYKVTCSVRQSSAQNRKYTIKVEVPKVATQTVGGEELPVAGWRSYLNMELTIPIFATNSDCELIVKAMQGLLKDGNPIPSAIAANSGIYSGGSSGGSSGSETPGTSESATPESSGGSSGGSSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 779 - protein, 881 aa, Artificial Sequence
  Synthetic
MKRTADGSEFESPKKKRKVGSASNFTQFVLVDNGGTGDVTVAPSNFANGVAEWISSNSRSQAYKVTCSVRQSSAQNRKYTIKVEVPKVATQTVGGEELPVAGWRSYLNMELTIPIFATNSDCELIVKAMQGLLKDGNPIPSAIAANSGIYSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSKRTADGSEFEPKKKRKV

SEQ ID NO: 780 - protein, 881 aa, Artificial Sequence
  Synthetic
MKRTADGSEFESPKKKRKVTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPSGGSSGGSSGSETPGTSESATPESSGGSSGGSSGSASNFTQFVLVDNGGTGDVTVAPSNFANGVAEWISSNSRSQAYKVTCSVRQSSAQNRKYTIKVEVPKVATQTVGGEELPVAGWRSYLNMELTIPIFATNSDCELIVKAMQGLLKDGNPIPSAIAANSGIYSGGSKRTADGSEFEPKKKRKV

SEQ ID NO: 781 - DNA, 48 bp, Artificial Sequence
  Synthetic
aggaaccccgggtctgactcgtgcactaccgtctcctttcctctgcag

SEQ ID NO: 782 - protein, 8 aa, Artificial Sequence
  Synthetic
SLGPRLST

SEQ ID NO: 783 - DNA, 45 bp, Artificial Sequence
  Synthetic
aaccccgggtctgactcgtgcactaccgtctcgtgtcctctgcag

SEQ ID NO: 784 - protein, 7 aa, Artificial Sequence
  Synthetic
LGPRLST

SEQ ID NO: 785 - DNA, 48 bp, Artificial Sequence
  Synthetic
tccttggggcccagactgagcacgtgatggcagaggaaaggagacgtc

SEQ ID NO: 786 - DNA, 48 bp, Artificial Sequence
  Synthetic
tccttggggcccagactgagcacgagatggcagaggaaaggagacgtc

SEQ ID NO: 787 - DNA, 45 bp, Artificial Sequence
  Synthetic
ttggggcccagactgagcacgtgatggcagagcacaggagacgtc

SEQ ID NO: 788 - DNA, 45 bp, Artificial Sequence
  Synthetic
ttggggcccagactgagcacgagatggcagagcacaggagacgtc

SEQ ID NO: 789 - DNA, 297 bp, Artificial Sequence
  Synthetic
atgtgggctgcctagaaaggcatggatgagagaagcctggagacagggatcccagggaaacgcccatgcaattagtctatttctgctgcaagtaagcatgcatttgtaggcttgatgctttttttctgcttctccagccctggcctgggtcaatccttggggcccagactgagcacgtgatggcagaggaaaggaagccctgcttcctccagagggcgtcgcaggacagcttttcctagacaggggctagtatgtgcagctcctgcaccgggatactggttgacaagtttggctggg

SEQ ID NO: 790 - DNA, 297 bp, Artificial Sequence
  Synthetic
cccagccaaacttgtcaaccagtatcccggtgcaggagctgcacatactagcccctgtctaggaaaagctgtcctgcgacgccctctggaggaagcagggcttcctttcctctgccatcacgtgctcagtctgggccccaaggattgacccaggccagggctggagaagcagaaaaaaagcatcaagcctacaaatgcatgcttacttgcagcagaaatagactaattgcatgggcgtttccctgggatccctgtctccaggcttctctcatccatgcctttctaggcagcccacat

SEQ ID NO: 791 - DNA, 40 bp, Artificial Sequence
  Synthetic
tggggcccagactgagcacgtgatggcagaggaaaggaag

SEQ ID NO: 792 - DNA, 40 bp, Artificial Sequence
  Synthetic
tggggcccagactgagcacgtgatggcaaaggaaaggaag

SEQ ID NO: 793 - DNA, 40 bp, Artificial Sequence
  Synthetic
tggggcccagactgagcacgagatggcagaggaaaggaag

SEQ ID NO: 794 - DNA, 40 bp, Artificial Sequence
  Synthetic
tggggcccagactgagcacgagatggcaaaggaaaggaag

SEQ ID NO: 795 - DNA, 29 bp, Artificial Sequence
  Synthetic
ctgagcacgtgatggcagaggaaaggaag

SEQ ID NO: 796 - DNA, 19 bp, Artificial Sequence
  Synthetic
ctgagcacgggaaaggaag

SEQ ID NO: 797 - DNA, 29 bp, Artificial Sequence
  Synthetic
ctgagcacgtgatggcaaaggaaaggaag

SEQ ID NO: 798 - DNA, 9 bp, Artificial Sequence
  Synthetic
ctgagcacg

SEQ ID NO: 799 - DNA, 16 bp, Artificial Sequence
  Synthetic
ctgagcacgggaaagg

SEQ ID NO: 800 - DNA, 29 bp, Artificial Sequence
  Synthetic
ctgagcacgtgatggcaggggaaaggaag

SEQ ID NO: 801 - DNA, 31 bp, Artificial Sequence
  Synthetic
gactgagcacgtgatggcagaggaaaggaag

SEQ ID NO: 802 - DNA, 31 bp, Artificial Sequence
  Synthetic
gactgagcacgcaccatcatcaccatcattg

SEQ ID NO: 803 - DNA, 31 bp, Artificial Sequence
  Synthetic
gactgagcacgtgatggcaaaggaaaggaag

SEQ ID NO: 804 - DNA, 31 bp, Artificial Sequence
  Synthetic
gactgagcacggattacaaggatgacgacga

SEQ ID NO: 805 - protein, 7 aa, Artificial Sequence
  Synthetic
GLGGTML

SEQ ID NO: 806 - DNA, 21 bp, Artificial Sequence
  Synthetic
ggccttggcggctacatgctg

SEQ ID NO: 807 - DNA, 21 bp, Artificial Sequence
  Synthetic
ggccttggcgtctacatgctg

SEQ ID NO: 808 - protein, 7 aa, Artificial Sequence
  Synthetic
GLGVTML

SEQ ID NO: 809 - DNA, 36 bp, Artificial Sequence
  Synthetic
ggggcagtggtggggggccttggcggctacatgctg

SEQ ID NO: 810 - DNA, 43 bp, Artificial Sequence
  Synthetic
gcagtggtggggggccttggatgtagacgccaaggccccccac

SEQ ID NO: 811 - protein, 25 aa, Artificial Sequence
  Synthetic
NFKIRHNIEDGSVQLADHYQQNTPI

SEQ ID NO: 812 - protein, 24 aa, Artificial Sequence
  Synthetic
NFKIHNIEDGSVQLADHYQQNTPI

SEQ ID NO: 813 - protein, 24 aa, Artificial Sequence
  Synthetic
NFKIRNIEDGSVQLADHYQQNTPI

SEQ ID NO: 814 - protein, 24 aa, Artificial Sequence
  Synthetic
NFKIRHNEDGSVQLADHYQQNTPI

SEQ ID NO: 815 - protein, 19 aa, Artificial Sequence
  Synthetic
NFKIRHNQLADHYQQNTPI

SEQ ID NO: 816 - protein, 20 aa, Artificial Sequence
  Synthetic
HNIEDGSVQLADHYQQNTPI

SEQ ID NO: 817 - protein, 14 aa, Artificial Sequence
  Synthetic
NFKIRHNIEDGSVQ

SEQ ID NO: 818 - DNA, 12 bp, Artificial Sequence
  Synthetic
actgcaagtgca

SEQ ID NO: 819 - DNA, 12 bp, Artificial Sequence
  Synthetic
tgcagtgttcac

SEQ ID NO: 820 - RNA, 122 nt, Artificial Sequence
  Synthetic
ggcccagacugagcacgugaguuuuagagcuagaaauagcaaguuaaaauaaggcuaguccguuaucaacuugaaaaaguggcaccgagucggugcucugccaucucgugcucagucuguuu

SEQ ID NO: 821 - DNA, 28 bp, Artificial Sequence
  Synthetic
ggcccagactgagcacgtgatggcagag

SEQ ID NO: 822 - DNA, 28 bp, Artificial Sequence
  Synthetic
gagatggcagagcagggggggggggggg

SEQ ID NO: 823 - DNA, 31 bp, Artificial Sequence
  Synthetic
gagatggcagagcaaaaaaaaaaaaaaaaaa

SEQ ID NO: 824 - DNA, 32 bp, Artificial Sequence
  Synthetic
ggcccagactgagcacgtgatggcagagcaca

SEQ ID NO: 825 - DNA, 32 bp, Artificial Sequence
  Synthetic
ggcccagactgagcacgagatggcagagcaca

SEQ ID NO: 826 - DNA, 24 bp, Artificial Sequence
  Synthetic
tccagatggcacattgtcagaggg

SEQ ID NO: 827 - DNA, 24 bp, Artificial Sequence
  Synthetic
tgacgggagggcagaactagtcct

SEQ ID NO: 828 - DNA, 24 bp, Artificial Sequence
  Synthetic
ttcagacagcatatttgagtcatt

SEQ ID NO: 829 - DNA, 40 bp, Artificial Sequence
  Synthetic
tggggcccagactgagcacgtgatggcagcggaaaggaag

SEQ ID NO: 830 - DNA, 40 bp, Artificial Sequence
  Synthetic
tggggcccagactgagcacgctttgatggcagaggaaagg

SEQ ID NO: 831 - DNA, 40 bp, Artificial Sequence
  Synthetic
tggggcccagactgagcacgcttttgatggcagaggaaag

SEQ ID NO: 832 - DNA, 39 bp, Artificial Sequence
  Synthetic
tggggcccagactgagcactgatggcagaggaaaggaag

SEQ ID NO: 833 - DNA, 38 bp, Artificial Sequence
  Synthetic
tggggcccagactgagcatgatggcagaggaaaggaag

SEQ ID NO: 834 - DNA, 38 bp, Artificial Sequence
  Synthetic
tggggcccagactgagcacgatggcagaggaaaggaag

SEQ ID NO: 835 - DNA, 40 bp, Artificial Sequence
  Synthetic
tggggcccagactgagcacggtgatggcagaggaaaggaa

SEQ ID NO: 836 - DNA, 39 bp, Artificial Sequence
  Synthetic
tggggcccagactgagcacggatggcagaggaaaggaag

SEQ ID NO: 837 - DNA, 40 bp, Artificial Sequence
  Synthetic
tggggcccagactgagcacgttgatggcagaggaaaggaa

SEQ ID NO: 838 - DNA, 32 bp, Artificial Sequence
  Synthetic
tggggcccagactgatggcagaggaaaggaag

SEQ ID NO: 839 - DNA, 40 bp, Artificial Sequence
  Synthetic
tggggcccagactgagcacgatgatggcagaggaaaggaa

SEQ ID NO: 840 - DNA, 34 bp, Artificial Sequence
  Synthetic
tggggcccagactgagcacgcagaggaaaggaag

SEQ ID NO: 841 - DNA, 26 bp, Artificial Sequence
  Synthetic
tggggctgatggcagaggaaaggaag

SEQ ID NO: 842 - DNA, 30 bp, Artificial Sequence
  Synthetic
tggggcccagactgagcagaggaaaggaag

SEQ ID NO: 843 - DNA, 40 bp, Artificial Sequence
  Synthetic
tggggcccagactgagcacgctgatggcagaggaaaggaa

SEQ ID NO: 844 - DNA, 27 bp, Artificial Sequence
  Synthetic
tggggcctgatggcagaggaaaggaag

SEQ ID NO: 845 - DNA, 25 bp, Artificial Sequence
  Synthetic
tggggtgatggcagaggaaaggaag

SEQ ID NO: 846 - DNA, 31 bp, Artificial Sequence
  Synthetic
tggggcccagactgagcacgaggaaaggaag

SEQ ID NO: 847 - DNA, 33 bp, Artificial Sequence
  Synthetic
tggggcccagactgagcacgagaggaaaggaag

SEQ ID NO: 848 - DNA, 36 bp, Artificial Sequence
  Synthetic
tggggcccagactgagcacgggcagaggaaaggaag

SEQ ID NO: 849 - DNA, 25 bp, Artificial Sequence
  Synthetic
tggggcccagactgaggaaaggaag

SEQ ID NO: 850 - DNA, 19 bp, Artificial Sequence
  Synthetic
tggggcagaggaaaggaag

SEQ ID NO: 851 - DNA, 29 bp, Artificial Sequence
  Synthetic
tggggcccagactgagcacggaaaggaag

SEQ ID NO: 852 - DNA, 28 bp, Artificial Sequence
  Synthetic
tggggcccagatggcagaggaaaggaag

SEQ ID NO: 853 - DNA, 28 bp, Artificial Sequence
  Synthetic
tggggcccagactgagcacgaaaggaag

SEQ ID NO: 854 - DNA, 21 bp, Artificial Sequence
  Synthetic
tggatggcagaggaaaggaag

SEQ ID NO: 855 - DNA, 39 bp, Artificial Sequence
  Synthetic
tggggcccagactgagctttgatggcagaggaaaggaag

SEQ ID NO: 856 - DNA, 23 bp, Artificial Sequence
  Synthetic
tggggcccagactgagcacgaag

SEQ ID NO: 857 - DNA, 32 bp, Artificial Sequence
  Synthetic
tggggcccagactgagcacggaggaaaggaag

SEQ ID NO: 858 - DNA, 24 bp, Artificial Sequence
  Synthetic
tggggcccagactgagcacggaag

SEQ ID NO: 859 - DNA, 21 bp, Artificial Sequence
  Synthetic
tggggcccagaggaaaggaag

SEQ ID NO: 860 - DNA, 30 bp, Artificial Sequence
  Synthetic
tggggcccagtgatggcagaggaaaggaag

SEQ ID NO: 861 - DNA, 23 bp, Artificial Sequence
  Synthetic
tggtgatggcagaggaaaggaag

SEQ ID NO: 862 - DNA, 40 bp, Artificial Sequence
  Synthetic
tggggcccagactgagcacgtgtgatggcagaggaaagga

SEQ ID NO: 863 - DNA, 18 bp, Artificial Sequence
  Synthetic
atggcagaggaaaggaag

SEQ ID NO: 864 - DNA, 34 bp, Artificial Sequence
  Synthetic
tggggcccagactgtgatggcagaggaaaggaag

SEQ ID NO: 865 - DNA, 36 bp, Artificial Sequence
  Synthetic
tggggcccagactgagtgatggcagaggaaaggaag

SEQ ID NO: 866 - DNA, 28 bp, Artificial Sequence
  Synthetic
tggggccctgatggcagaggaaaggaag

SEQ ID NO: 867 - DNA, 35 bp, Artificial Sequence
  Synthetic
tggggcccagactgagcacggcagaggaaaggaag

SEQ ID NO: 868 - DNA, 40 bp, Artificial Sequence
  Synthetic
cctgaaccgtatatcctatggccctgactggaaggatttc

SEQ ID NO: 869 - DNA, 40 bp, Artificial Sequence
  Synthetic
aaccgtatatctatcctatggccctgactggaaggatttc

SEQ ID NO: 870 - DNA, 40 bp, Artificial Sequence
  Synthetic
aaccgtatatctatcctattgccctgactggaaggatttc

SEQ ID NO: 871 - DNA, 40 bp, Artificial Sequence
  Synthetic
aaccgtatatctatcctatgtccctgactggaaggatttc

SEQ ID NO: 872 - DNA, 40 bp, Artificial Sequence
  Synthetic
aaccgtatatctatcctatggccctgactggaaggctttc

SEQ ID NO: 873 - DNA, 40 bp, Artificial Sequence
  Synthetic
aaccgtatatctatcctctggccctgactggaaggatttc

SEQ ID NO: 874 - DNA, 40 bp, Artificial Sequence
  Synthetic
aaccgtatatctatcctctggccctgactggaaggctttc

SEQ ID NO: 875 - DNA, 40 bp, Artificial Sequence
  Synthetic
caccatggtgcacctgactcctgaggagaagtctgccgtt

SEQ ID NO: 876 - DNA, 40 bp, Artificial Sequence
  Synthetic
caccatggtgcacctgactcctgtggagaagtctgccgtt

SEQ ID NO: 877 - DNA, 40 bp, Artificial Sequence
  Synthetic
caccatggcgcacctgactcctgtggagaagtctgccgtt

SEQ ID NO: 878 - DNA, 40 bp, Artificial Sequence
  Synthetic
caccatggtgcacctgactcctgtggagaagtctgtcgtt

SEQ ID NO: 879 - DNA, 29 bp, Artificial Sequence
  Synthetic
  misc_feature (5)..(24): n is a, c, g, or t
caccnnnnnnnnnnnnnnnnnnnngtttt

SEQ ID NO: 880 - DNA, 29 bp, Artificial Sequence
  Synthetic
  misc_feature (10)..(29): n is a, c, g, or t
ctctaaaacnnnnnnnnnnnnnnnnnnnn

SEQ ID NO: 881 - DNA, 67 bp, Artificial Sequence
  Synthetic
agagctagaaatagcaagttaaaataaggctagtccgttatcaacttgaaaaagtggcaccgagtcg

SEQ ID NO: 882 - DNA, 67 bp, Artificial Sequence
  Synthetic
gcaccgactcggtgccactttttcaagttgataacggactagccttattttaacttgctatttctag

SEQ ID NO: 883 - DNA, 34 bp, Artificial Sequence
  Synthetic
  misc_feature (5)..(34): n is a, c, g, or t
gtgcnnnnnnnnnnnnnnnnnnnnnnnnnnnnnn

SEQ ID NO: 884 - DNA, 34 bp, Artificial Sequence
  Synthetic
  misc_feature (5)..(34): n is a, c, g, or t
aaaannnnnnnnnnnnnnnnnnnnnnnnnnnnnn

SEQ ID NO: 885 - DNA, 104 bp, Artificial Sequence
  Synthetic
cagaggaccgactcggtcccactttttcaagttgataacggactagccttattttaacttgctatttctagctctaaaactcacgtgctcagtctgggccggtg

SEQ ID NO: 886 - DNA, 105 bp, Artificial Sequence
  Synthetic
atcacgcaccgactcggtgccactttttcaagttgataacggactagccttattttaacttgctatttctagctctaaaacttcttcttctgctcggactcggtg

SEQ ID NO: 887 - DNA, 105 bp, Artificial Sequence
  Synthetic
tttccgcaccgactcggtgccactttttcaagttgataacggactagccttattttaacttgctatttctagctctaaaacggtgctgcagaagggattccggtg

SEQ ID NO: 888 - DNA, 105 bp, Artificial Sequence
  Synthetic
tcgttgcaccgactcggtgccactttttcaagttgataacggactagccttattttaacttgctatttctagctctaaaaccaggtaatgactaagatgacggtg

SEQ ID NO: 889 - DNA, 75 bp, Artificial Sequence
  Synthetic
tccttggggcccagactgagcacgtgatggcagaggaaaggaagccctgcttcctccagagggcgtcgcaggaca

SEQ ID NO: 890 - protein, 24 aa, Artificial Sequence
  Synthetic
SLGPRLSTWQRKGSPASSRGRRRT

SEQ ID NO: 891 - DNA, 75 bp, Artificial Sequence
  Synthetic
tgtcctgcgacgccctctggaggaagcagggcttcctttcctctgccatcacgtgctcagtctgggccccaagga

SEQ ID NO: 892 - DNA, 201 bp, Artificial Sequence
  Synthetic
tattattactctatgttctatttaagttttcatgttctaaaaatgtatcccagtttacacgtctcatatgccccttggcagtcatcttagtcattacctgaggtgttcgttgtaactcatataaactgagttcccatgttttgcttaatggttgagttccgtttgtctgcacagcctgagacattgctggaaataaagaag

SEQ ID NO: 893 - DNA, 201 bp, Artificial Sequence
  Synthetic
cttctttatttccagcaatgtctcaggctgtgcagacaaacggaactcaaccattaagcaaaacatgggaactcagtttatatgagttacaacgaacacctcaggtaatgactaagatgactgccaaggggcatatgagacgtgtaaactgggatacatttttagaacatgaaaacttaaatagaacatagagtaataata

SEQ ID NO: 894 - DNA, 20 bp, Artificial Sequence
  Synthetic
gtcatcttagtcattacctg

SEQ ID NO: 895 - DNA, 29 bp, Artificial Sequence
  Synthetic
aacgaacaccgcaggtaatgactaagatg

SEQ ID NO: 896 - DNA, 76 bp, Artificial Sequence; identical to SEQ ID NO: 131
  Synthetic

SEQ ID NO: 897 - RNA, 126 nt, Artificial Sequence
  Synthetic
  misc_feature (99)..(123): n is a, c, g, or u
gaaggcaauaaugcuaauuacaguuuuagagcuagaaauagcaaguuaaaauaaggcuaguccguuaucaacuugaaaaaguggcaccgaguaggugcnnnnnnnnnnnnnnnnnnnnnnnnnuuu

SEQ ID NO: 898 - RNA, 135 nt, Artificial Sequence
  Synthetic
  misc_feature (99)..(123): n is a, c, g, or u
  misc_feature (128)..(132): n is a, c, g, or u
gaaggcaauaaugcuaauuacaguuuuagagcuagaaauagcaaguuaaaauaaggcuaguccguuaucaacuugaaaaaguggcaccgaguaggugcnnnnnnnnnnnnnnnnnnnnnnnnngaaannnnnuuu

SEQ ID NO: 899 - protein, 18 aa, Artificial Sequence
  Synthetic
AACAGNRVRRSVGSSLKC

SEQ ID NO: 900 - protein, 15 aa, Artificial Sequence
  Synthetic
AADHCPVVEVNGVTI

SEQ ID NO: 901 - protein, 13 aa, Artificial Sequence
  Synthetic
AAHLPTGTPLDID

SEQ ID NO: 902 - protein, 12 aa, Artificial Sequence
  Synthetic
AALAVWAGLAVQ

SEQ ID NO: 903 - protein, 15 aa, Artificial Sequence
  Synthetic
AALGVATAAQITAGI

SEQ ID NO: 904 - protein, 24 aa, Artificial Sequence
  Synthetic
AALLNTPPPYQVSCGGESDRATAR

SEQ ID NO: 905 - protein, 15 aa, Artificial Sequence
  Synthetic
AAQSFTGVVYGTHTT

SEQ ID NO: 906 - protein, 15 aa, Artificial Sequence
  Synthetic
ACEVEPAFGHSDAAC

SEQ ID NO: 907 - protein, 15 aa, Artificial Sequence
  Synthetic
ACTFWAVNAYSSGGY

SEQ ID NO: 908 - protein, 7 aa, Artificial Sequence
  Synthetic
ADDPLLR

SEQ ID NO: 909 - protein, 8 aa, Artificial Sequence
  Synthetic
ADDPLLRT

SEQ ID NO: 910 - protein, 15 aa, Artificial Sequence
  Synthetic
AEMICDIDTYIVEAG

SEQ ID NO: 911 - protein, 20 aa, Artificial Sequence
  Synthetic
AEMICDIDTYIVEAGLASFI

SEQ ID NO: 912 - protein, 7 aa, Artificial Sequence
  Synthetic
AEPLLSC

SEQ ID NO: 913 - protein, 15 aa, Artificial Sequence
  Synthetic
AFVSTSSSRRYTEVY

SEQ ID NO: 914 - protein, 31 aa, Artificial Sequence
  Synthetic
AGFIYRETFCITTIYKTGQPAADHYYSKVTA

SEQ ID NO: 915 - protein, 15 aa, Artificial Sequence
  Synthetic
AGLLACCAKCLYYLR

SEQ ID NO: 916 - protein, 12 aa, Artificial Sequence
  Synthetic
AHTTSDPWHPPG

SEQ ID NO: 917 - protein, 15 aa, Artificial Sequence
  Synthetic
AIAKLEDAKELLESS

SEQ ID NO: 918 - protein, 15 aa, Artificial Sequence
  Synthetic
AIDNLRASLETTNQA

SEQ ID NO: 919 - protein, 7 aa, Artificial Sequence
  Synthetic
AKGVEFR

SEQ ID NO: 920 - protein, 15 aa, Artificial Sequence
  Synthetic
AKWAVPTTRTDDKLR

SEQ ID NO: 921 - protein, 10 aa, Artificial Sequence
  Synthetic
ALAEVLKKPV

SEQ ID NO: 922 - protein, 15 aa, Artificial Sequence
  Synthetic
ALGVINTLEWIPRFK

SEQ ID NO: 923 - protein, 15 aa, Artificial Sequence
  Synthetic
ALHQSMLNSQAIDNL

SEQ ID NO: 924 - protein, 10 aa, Artificial Sequence
  Synthetic
ALIGILSLFV

SEQ ID NO: 925 - protein, 20 aa, Artificial Sequence
  Synthetic
ALLNTPPPYQVSCGGESDRA

SEQ ID NO: 926 - protein, 24 aa, Artificial Sequence
  Synthetic
ALLNTPPPYQVSCGGESDRASARV

SEQ ID NO: 927 - protein, 15 aa, Artificial Sequence
  Synthetic
ALVEGLAPGGGNCHL

SEQ ID NO: 928 - protein, 12 aa, Artificial Sequence
  Synthetic
AMAAWSERAGEA

SEQ ID NO: 929 - protein, 15 aa, Artificial Sequence
  Synthetic
ANCASILCKCYTTGT

SEQ ID NO: 930 - protein, 12 aa, Artificial Sequence
  Synthetic
ANPNPYTSRRSV

SEQ ID NO: 931 - protein, 8 aa, Artificial Sequence
  Synthetic
APGPGEVW

SEQ ID NO: 932 - protein, 23 aa, Artificial Sequence
  Synthetic
APLPPHTTERIETRSARHPWRIR

SEQ ID NO: 933 - protein, 27 aa, Artificial Sequence
  Synthetic
APPMPPQPPRAHGQHYGHHHHQLPFLG

SEQ ID NO: 934 - protein, 27 aa, Artificial Sequence
  Synthetic
APPTLPQPPCAHGQHYGHHHHQLPFLG

SEQ ID NO: 935 - protein, 27 aa, Artificial Sequence
  Synthetic
APPTLPQPPRAHGQHYGHHHHQLPFLG

SEQ ID NO: 936 - protein, 22 aa, Artificial Sequence
  Synthetic
APQPGPQPPQPPQPQPEAPAPQ

SEQ ID NO: 937 - protein, 15 aa, Artificial Sequence
  Synthetic
AQLASYFNPGGSYYK

SEQ ID NO: 938 - protein, 13 aa, Artificial Sequence
  Synthetic
ARAAHLPTGTPLD

SEQ ID NO: 939 - protein, 15 aa, Artificial Sequence
  Synthetic
ARLVSEIAMHTTEDK

SEQ ID NO: 940 - protein, 20 aa, Artificial Sequence
  Synthetic
ARLVSEIAMHTTEDKISRAV

SEQ ID NO: 941 - protein, 17 aa, Artificial Sequence
  Synthetic
ASDVETAEGGEIHELLR

SEQ ID NO: 942 - protein, 19 aa, Artificial Sequence
  Synthetic
ASDVETAEGGEIHELLRLQ

SEQ ID NO: 943 - protein, 21 aa, Artificial Sequence
  Synthetic
ASDVETAEGGEIHELLRLQSR

SEQ ID NO: 944 - protein, 19 aa, Artificial Sequence
  Synthetic
ASDVETAEGGEIHKLLRLQ

SEQ ID NO: 945 - protein, 12 aa, Artificial Sequence
  Synthetic
ASDVLPGHWLQG

SEQ ID NO: 946 - protein, 15 aa, Artificial Sequence
  Synthetic
ASELGITAEDARLVS

SEQ ID NO: 947 - protein, 20 aa, Artificial Sequence
  Synthetic
ASELGITAEDARLVSEIAMH

SEQ ID NO: 948 - protein, 13 aa, Artificial Sequence
  Synthetic
ASESSQDPQDSRR

SEQ ID NO: 949 - protein, 15 aa, Artificial Sequence
  Synthetic
ASILCKCYTTGTIIN

SEQ ID NO: 950 - protein, 15 aa, Artificial Sequence
  Synthetic
ASPVCQRHSPDCSRL

SEQ ID NO: 951 - protein, 12 aa, Artificial Sequence
  Synthetic
ASQARWTGATRA

SEQ ID NO: 952 - protein, 28 aa, Artificial Sequence
  Synthetic
ASYFNPGGSYYKQYHPTACEVEPAFGHS

SEQ ID NO: 953 - protein, 15 aa, Artificial Sequence
  Synthetic
ASYKVMTRSSHQSLV

SEQ ID NO: 954 - protein, 12 aa, Artificial Sequence
  Synthetic
ASYVKKPKEDVD

SEQ ID NO: 955 - protein, 15 aa, Artificial Sequence
  Synthetic
ATAAQITAGIALHQS

SEQ ID NO: 956 - protein, 8 aa, Artificial Sequence
  Synthetic
ATPERPRL

SEQ ID NO: 957 - protein, 15 aa, Artificial Sequence
  Synthetic
AVCLGGLIGIPALIC

SEQ ID NO: 958 - protein, 11 aa, Artificial Sequence
  Synthetic
AVGPRQAQVSF

SEQ ID NO: 959 - protein, 15 aa, Artificial Sequence
  Synthetic
AVNAYSSGGYAQLAS

SEQ ID NO: 960 - protein, 15 aa, Artificial Sequence
  Synthetic
AVSETRQTWAEWAAA

SEQ ID NO: 961 - protein, 15 aa, Artificial Sequence
  Synthetic
AVTAPDTAADSELRR

SEQ ID NO: 962 - protein, 20 aa, Artificial Sequence
  Synthetic
AVTAPDTAADSELRRWIKYT

SEQ ID NO: 963 - protein, 22 aa, Artificial Sequence
  Synthetic
AYGGIIKDAPPGAGFIYRETFC

SEQ ID NO: 964 - protein, 15 aa, Artificial Sequence
  Synthetic
CALPLAGLLACCAKC

SEQ ID NO: 965 - protein, 15 aa, Artificial Sequence
  Synthetic
CARIWNGTQRACTFW

SEQ ID NO: 966 - protein, 15 aa, Artificial Sequence
  Synthetic
CARTLVSGSFGNRFI

SEQ ID NO: 967 - protein, 22 aa, Artificial Sequence
  Synthetic
CASPYEGRYRDMYDALRBRLLY

SEQ ID NO: 968 - protein, 14 aa, Artificial Sequence
  Synthetic
CAVFVRSGQPVIGA

SEQ ID NO: 969 - protein, 16 aa, Artificial Sequence
  Synthetic
CCAKCLYYLRGAIAPR

SEQ ID NO: 970 - protein, 15 aa, Artificial Sequence
  Synthetic
CCRGRCNKKGEQVGM

SEQ ID NO: 971 - protein, 15 aa, Artificial Sequence
  Synthetic
CEIPTDVSCEGLGAW

SEQ ID NO: 972 - protein, 16 aa, Artificial Sequence
  Synthetic
CFGKDLKRPGSSPMEV

SEQ ID NO: 973 - protein, 15 aa, Artificial Sequence
  Synthetic
CFQQACKGKIQALCE

SEQ ID NO: 974 - protein, 29 aa, Artificial Sequence
  Synthetic
CFQQACKGKIQALCENPEWAPLKDNRIPS

SEQ ID NO: 975 - protein, 15 aa, Artificial Sequence
  Synthetic
CGGESDRASARVIDP

SEQ ID NO: 976 - protein, 22 aa, Artificial Sequence
  Synthetic
CITTIYKTGQPAADHYYSKVTA

SEQ ID NO: 977 - protein, 15 aa, Artificial Sequence
  Synthetic
CKGKIQALCENPEWA

SEQ ID NO: 978 - protein, 13 aa, Artificial Sequence
  Synthetic
CKPWQESRKNKAQ

SEQ ID NO: 979 - protein, 15 aa, Artificial Sequence
  Synthetic
CNKKGEQVGMSRPGL

SEQ ID NO: 980 - protein, 15 aa, Artificial Sequence
  Synthetic
CNVTTEHPFCNTPHG

SEQ ID NO: 981 - protein, 10 aa, Artificial Sequence
  Synthetic
CQVGSSNSAF

SEQ ID NO: 982 - protein, 12 aa, Artificial Sequence
  Synthetic
CSGPTTIRGQFS

SEQ ID NO: 983 - protein, 16 aa, Artificial Sequence
  Synthetic
CTSPYDGKYWSMYSRL

SEQ ID NO: 984 - protein, 15 aa, Artificial Sequence
  Synthetic
CVLADSESGGHITHS

SEQ ID NO: 985 - protein, 24 aa, Artificial Sequence
  Synthetic
CYTTGTIINQDPDKILTYIAADHC

SEQ ID NO: 986 - protein, 8 aa, Artificial Sequence
  Synthetic
DADDPLLR

SEQ ID NO: 987 - protein, 15 aa, Artificial Sequence
  Synthetic
DARAAHLPTGTPLDI

SEQ ID NO: 988 - protein, 20 aa, Artificial Sequence
  Synthetic
DARAAHLPTGTPLDIDTASE

SEQ ID NO: 989 - protein, 15 aa, Artificial Sequence
  Synthetic
DCHAPTYLPAEVDGD

SEQ ID NO: 990 - protein, 15 aa, Artificial Sequence
  Synthetic
DCSRLVGATPERPRL

SEQ ID NO: 991 - protein, 15 aa, Artificial Sequence
  Synthetic
DDKLRMETCFQQACK

SEQ ID NO: 992 - protein, 8 aa, Artificial Sequence
  Synthetic
DDPLLRTA

SEQ ID NO: 993 - protein, 15 aa, Artificial Sequence
  Synthetic
DDPLLRTAPGPGEVW

SEQ ID NO: 994 - protein, 11 aa, Artificial Sequence
  Synthetic
DDPPATVYRYD

SEQ ID NO: 995 - protein, 17 aa, Artificial Sequence
  Synthetic
DDPPATVYRYDSRPPED

SEQ ID NO: 996 - protein, 18 aa, Artificial Sequence
  Synthetic
DDPPATVYRYDSRPPEDV

SEQ ID NO: 997 - protein, 15 aa, Artificial Sequence
  Synthetic
DEVGLRTPQRFTDLV

SEQ ID NO: 998 - protein, 15 aa, Artificial Sequence
  Synthetic
DHCPVVEVNGVTIQV

SEQ ID NO: 999 - protein, 13 aa, Artificial Sequence
  Synthetic
DIDTASESSQDPQ

SEQ ID NO: 1000 - protein, 15 aa, Artificial Sequence
  Synthetic
DINKVLEKLGYSGGD

SEQ ID NO: 1001 - protein, 7 aa, Artificial Sequence
  Synthetic
DLIAYKQ

SEQ ID NO: 1002 - protein, 15 aa, Artificial Sequence
  Synthetic
DLIGQKLGLKLLRYY

SEQ ID NO: 1003 - protein, 19 aa, Artificial Sequence
  Synthetic
DLQKALEAQSRALRAELAA

SEQ ID NO: 1004 - protein, 15 aa, Artificial Sequence
  Synthetic
DLQYVLATYDTSRVE

SEQ ID NO: 1005 - protein, 9 aa, Artificial Sequence
  Synthetic
DLSLRRFMV

SEQ ID NO: 1006 - protein, 15 aa, Artificial Sequence
  Synthetic
DLSNCMVALGELKLA

SEQ ID NO: 1007 - protein, 24 aa, Artificial Sequence
  Synthetic
DLVEYIMNYTGNQQSRWGLGSPNC

SEQ ID NO: 1008 - protein, 15 aa, Artificial Sequence
  Synthetic
DLVKFISDKIKFLNP

SEQ ID NO: 1009 - protein, 15 aa, Artificial Sequence
  Synthetic
DLVKFISTKIKFLNP

SEQ ID NO: 1010 - protein, 10 aa, Artificial Sequence
  Synthetic
DLYKSNHNNV

SEQ ID NO: 1011 - protein, 10 aa, Artificial Sequence
  Synthetic
DNVLDHLTGR

SEQ ID NO: 1012 - protein, 12 aa, Artificial Sequence
  Synthetic
DNVLDHLTGRSC

SEQ ID NO: 1013 - protein, 13 aa, Artificial Sequence
  Synthetic
DNVLDHLTGRSCQ

SEQ ID NO: 1014 - protein, 11 aa, Artificial Sequence
  Synthetic
DPDKILTYIAA

SEQ ID NO: 1015 - protein, 19 aa, Artificial Sequence
  Synthetic
DPGDLVEYIMNYTGNQQSR

SEQ ID NO: 1016 - protein, 8 aa, Artificial Sequence
  Synthetic
DPLLRTAP

SEQ ID NO: 1017 - protein, 22 aa, Artificial Sequence
  Synthetic
DPLLRTAPGPGEVWVTPVIGSQ

SEQ ID NO: 1018 - protein, 13 aa, Artificial Sequence
  Synthetic
DPQDSRRSAEPLL

SEQ ID NO: 1019 - protein, 15 aa, Artificial Sequence
  Synthetic
DPVIDRLYLSSHRGV

SEQ ID NO: 1020 - protein, 15 aa, Artificial Sequence
  Synthetic
DQILRSMKGLSSTSI

SEQ ID NO: 1021 - protein, 15 aa, Artificial Sequence
  Synthetic
DQYCADVAAEELMNA

SEQ ID NO: 1022 - protein, 10 aa, Artificial Sequence
  Synthetic
DSESGGHITH

SEQ ID NO: 1023 - protein, 13 aa, Artificial Sequence
  Synthetic
DTASESSQDPQDS

SEQ ID NO: 1024 - protein, 15 aa, Artificial Sequence
  Synthetic
DTVMSVFALASYVQH

SEQ ID NO: 1025 - protein, 14 aa, Artificial Sequence
  Synthetic
DVFQNGFTAWGNND

SEQ ID NO: 1026 - protein, 15 aa, Artificial Sequence
  Synthetic
DVGAVPPGKFVTAAL

SEQ ID NO: 1027 - protein, 16 aa, Artificial Sequence
  Synthetic
DVNKSKTHISVNGRKI

SEQ ID NO: 1028 - protein, 15 aa, Artificial Sequence
  Synthetic
DVSCEGLGAWVPAAP

SEQ ID NO: 1029 - protein, 27 aa, Artificial Sequence
  Synthetic
DWASPVCQRHSPDCSRLVGATPERPRL

SEQ ID NO: 1030 - protein, 13 aa, Artificial Sequence
  Synthetic
EARESYRETGPSR

SEQ ID NO: 1031 - protein, 13 aa, Artificial Sequence
  Synthetic
EAVEAERAGRGTG

SEQ ID NO: 1032 - protein, 15 aa, Artificial Sequence
  Synthetic
EDAKELLESSDQILR

SEQ ID NO: 1033 - protein, 13 aa, Artificial Sequence
  Synthetic
EDRRVKQSRGEAR

SEQ ID NO: 1034 - protein, 15 aa, Artificial Sequence
  Synthetic
EDSITIPYQGSGKGV

SEQ ID NO: 1035 - protein, 15 aa, Artificial Sequence
  Synthetic
EEAFTYLCTAPGCAT

SEQ ID NO: 1036 - protein, 15 aa, Artificial Sequence
  Synthetic
EGFNMILGTILAQIW

SEQ ID NO: 1037 - protein, 20 aa, Artificial Sequence
  Synthetic
EGFNMILGTILAQIWVLLAK

SEQ ID NO: 1038 - protein, 15 aa, Artificial Sequence
  Synthetic
EHPFCNTPHGQLEVQ

SEQ ID NO: 1039 - protein, 15 aa, Artificial Sequence
  Synthetic
EISDIEVQDPEGFNM

SEQ ID NO: 1040 - protein, 20 aa, Artificial Sequence
  Synthetic
EISDIEVQDPEGFNMILGTI

SEQ ID NO: 1041 - protein, 11 aa, Artificial Sequence
  Synthetic
EKPNLSSKRSE

SEQ ID NO: 1042 - protein, 15 aa, Artificial Sequence
  Synthetic
ELKLAALCHGEDSIT

SEQ ID NO: 1043 - protein, 15 aa, Artificial Sequence
  Synthetic
ELMNALVNSTLLETR

SEQ ID NO: 1044 - protein, 5 aa, Artificial Sequence
  Synthetic
ELPRL

SEQ ID NO: 1045 - protein, 23 aa, Artificial Sequence
  Synthetic
ENPEWAPLKDNRIPSYGVLSVDL

SEQ ID NO: 1046 - protein, 15 aa, Artificial Sequence
  Synthetic
EPIRDALNAMTQNIR

SEQ ID NO: 1047 - protein, 15 aa, Artificial Sequence
  Synthetic
EQVGMSRPGLKPDLT

SEQ ID NO: 1048 - protein, 8 aa, Artificial Sequence
  Synthetic
ERPRLRLV

SEQ ID NO: 1049 - protein, 15 aa, Artificial Sequence
  Synthetic
ERPRLRLVDADDPLL

SEQ ID NO: 1050 - protein, 17 aa, Artificial Sequence
  Synthetic
ESPGQLIQRITDDPDVS

SEQ ID NO: 1051 - protein, 15 aa, Artificial Sequence
  Synthetic
ESRGIKARITHVDTE

SEQ ID NO: 1052 - protein, 15 aa, Artificial Sequence
  Synthetic
ESSCTFMPEGTVCSQ

SEQ ID NO: 1053 - protein, 13 aa, Artificial Sequence
  Synthetic
ESSQDPQDSRRSA

SEQ ID NO: 1054 - protein, 15 aa, Artificial Sequence
  Synthetic
ETRTTNQFLAVSKGN

SEQ ID NO: 1055 - protein, 15 aa, Artificial Sequence
  Synthetic
EVDGDVKLSSNLVIL

(The sequence listing continues in the following parts.)

What is claimed is:

1. A method for site-specific modification of a double-stranded target DNA sequence, the method comprising:
   contacting the double-stranded target DNA sequence, which comprises a first strand and a second strand, with a prime editing system, wherein the prime editing system comprises:
   (i) a fusion protein comprising a nucleic acid programmable DNA binding protein (napDNAbp) and a reverse transcriptase, wherein the napDNAbp is a Cas9 nickase, a Cas12a nickase, or a Cas12b1 nickase, and
   (ii) a prime editing guide RNA (PEgRNA) comprising:
      (a) a spacer sequence that comprises a region of complementarity to the first strand of the double-stranded target DNA sequence;
      (b) an extension arm that comprises a DNA synthesis template and a primer binding site in a 5' to 3' orientation, wherein the primer binding site comprises a region of complementarity to a region upstream of a nick site in the second strand of the double-stranded target DNA sequence, and wherein the DNA synthesis template encodes one or more nucleotide changes compared to a region downstream of the nick site in the second strand of the double-stranded target DNA sequence, and
      (c) a gRNA core that interacts with the napDNAbp;

wherein the contacting results in:
   nicking the second strand of the double-stranded target DNA sequence to form a free 3' end at the nick site;
   annealing the primer binding site with the region of the second strand of the double-stranded target DNA sequence upstream of the nick site;

synthesizing a single strand of DNA encoded by the DNA synthesis template from the free 3' end of the second strand of the double-stranded target DNA sequence; and replacing the region downstream of the nick site in the second strand of the double-stranded target DNA sequence with the single strand of DNA, thereby modifying the sequence of the double-stranded target DNA sequence.

2. The method of claim 1, wherein the one or more nucleotide changes are 1-150 bases downstream of the nick site on the second strand.

3. The method of claim 1, wherein the DNA synthesis template comprises a region of complementarity to the second strand of the double-stranded target DNA sequence.

4. The method of claim 1, wherein the one or more nucleotide changes comprise a nucleotide substitution as compared to the region of the second strand downstream of the nick site in the double-stranded target DNA sequence.

5. The method of claim 1, wherein the one or more nucleotide changes comprise a nucleotide deletion as compared to the region of the second strand downstream of the nick site in the double-stranded target DNA sequence.

6. The method of claim 1, wherein the one or more nucleotide changes comprise a nucleotide insertion as compared to the region of the second strand downstream of the nick site in the double-stranded target DNA sequence.

7. The method of claim 1, wherein the one or more nucleotide changes comprise two or more nucleotide insertions, nucleotide substitutions, nucleotide deletions, or a combination of two or more of a nucleotide insertion, a nucleotide substitution, or a nucleotide deletion, as compared to the region of the second strand downstream of the nick site in the double-stranded target DNA sequence.

8. The method of claim 1, wherein the napDNAbp is a Cas9 nickase (nCas9).

9. The method of claim 8, wherein the Cas9 nickase is a Cas9 nickase (nCas9) comprising a substitution in the HNH domain.

10. The method of claim 9, wherein the substitution in the HNH domain is H840A relative to SEQ ID NO: 18.

11. The method of claim 1, wherein the reverse transcriptase is a retrovirus reverse transcriptase.

12. The method of claim 1, wherein the reverse transcriptase is a Moloney Murine Leukemia reverse transcriptase (M-MLV RT).

13. The method of claim 1, wherein the contacting is performed in a cell comprising the double-stranded target DNA sequence, and wherein the contacting results in less than 1% off-target editing in a genome of the cell as measured by sequencing.

14. The method of claim 1, wherein the contacting is performed in a population of cells each comprising the double-stranded target DNA sequence, and wherein the contacting results in the nucleotide change in at least 1% of the population of cells.

15. The method of claim 1, wherein the contacting is performed in a population of cells each comprising the double-stranded target DNA sequence, and wherein the contacting results in less than 15% indel frequency as measured by sequencing.

16. The method of claim 1 further comprising contacting the double-stranded target DNA sequence with a guide RNA, wherein the guide RNA directs the napDNAbp to generate a second nick on the first strand of the double-stranded target DNA sequence.

17. The method of claim 16, wherein the first nick and the second nick are at least 14 nucleotides apart.

18. The method of claim 1, wherein the one or more nucleotide changes comprise a single nucleotide substitution, a single nucleotide insertion, a single nucleotide deletion, or combinations thereof, as compared to the region of the second strand downstream of the nick site in the double-stranded target DNA sequence.

19. The method of claim 1, wherein the one or more nucleotide changes are 4-6 bases downstream of the position of the nick site on the second strand in the double-stranded target DNA sequence.

20. The method of claim 1, wherein the one or more nucleotide changes are at least 7 base pairs downstream of the position of the nick site on the second strand in the double-stranded target DNA sequence, and wherein the DNA synthesis template is at least 12 bases in length.

21. The method of claim 1, wherein the contacting is performed in a population of cells each comprising the double-stranded target DNA sequence, and wherein the contacting results in the one or more nucleotide changes in at least 20% of the population of cells.

22. The method of claim 1, wherein the contacting is performed in a population of cells each comprising the double-stranded target DNA sequence, and wherein the contacting results in the one or more nucleotide changes in at least 50% of the population of cells.

23. The method of claim 1, wherein the contacting is performed in a population of cells each comprising the double-stranded target DNA sequence, and wherein the contacting results in less than 10% indel frequency as measured by sequencing.

24. The method of claim 1, wherein the contacting is performed in a population of cells each comprising the double-stranded target DNA sequence, and wherein the contacting results in less than 1% indel frequency as measured by sequencing.

25. The method of claim 8, wherein the nCas9 nickase is derived from a *Streptococcus pyogenes* Cas9, a *Staphylococcus aureus* Cas9, a *Neisseria meningitis* Cas9, a *Streptococcus thermophilis* Cas9, or a *Treponema denticola* Cas9.

26. The method of claim 1, wherein the DNA synthesis template is from 3 nucleotides to 500 nucleotides in length.

27. The method of claim 1, wherein the DNA synthesis template is from 8 nucleotides to 31 nucleotides in length.

28. The method of claim 1, wherein the primer binding site is from 3 nucleotides to 500 nucleotides in length.

29. The method of claim 1, wherein the primer binding site is from 8 nucleotides to 15 nucleotides in length.

30. The method of claim 1, wherein the spacer sequence is about 20 nucleotides in length.

* * * * *